United States Patent 6,610,836 (NUCLEIC ACID AMINO ACID SEQUENCES RELATING TO KLEBSIELLA PNEUMONIAE FOR DIAGNOSTICS AND THERAPEUTICS) - sequence listing, part 5

SEQ ID NO: 13592 - protein, 103 aa, Klebsiella pneumoniae
SRPSSVMRTPRPWRIKSVTPTRASSCLMCWLTAEWVTLNSWAACVTLPRRATASKLRRLATGGKSAMVVSLSVSRYVNVTTGLAAFKAAANRLKRSQMPPQSV

SEQ ID NO: 13593 - protein, 94 aa, Klebsiella pneumoniae
LITSLVFGILTGEHLPHSTTVISRRLRLKMSKTLIRLSEVRRRTGYSKAWIYRLISEHRFPQPIKIGARAIAFVEGEIDEWIERRIAESRGELA

SEQ ID NO: 13594 - protein, 426 aa, Klebsiella pneumoniae
NPHSCGGTFGGRFLFNEMRYPQVKLTARQVDTSKAKDKPYKLSDGGGLYLLVNPNGARYWRLKYRVAGKEKSLALGVYPEVSLADARQKRAEAKKVLAAGGDPGQEKQEKKHARAMAVSNSFERLALEWHEHKSMNWSAGYASDILEYLRKDIFPYIGSRSITDIKPVDMLAVLRKMEQRGVLDKLKKTRQACRQIFTYAVITGRAEHNPVVDLASTLKAPKQKHFPHLSVEQIPDFLRALNDYSGSVVTRNATRLLMLTGLRTIELRASEWVDIDFDKGIWNIPAERMKMRRPHLVPISTQVRELLEEIHQLTGRGKYVFPGRNDAGKPMSEASINQVIKRIGYDGKATGHGFRHTMSTILHEQGYNTAWIETQLAHVDKNSIRGTYNHAQYLDGRREMLQWYADYMQALENGENVVHGSFGKRA

SEQ ID NO: 13595 - protein, 342 aa, Klebsiella pneumoniae
ISHSRARIVMLWSPPDQCERYRRKRAKNPVNLTDSALRIIAMTIHVTDVAIVGGGMVGGALALGLAQQGFTVTVLEKAAPPAFDPASAPDVRISAISAASIGLLKSLGVWDAIRAMRVHAYRRLETWEWESAHVAFDAAELKLPELGYMVENKVLQWGLWQALAAHEAVTLRVGSELKKMQRGETQTALHLREGETIHARLVIGADGANSQVREMAGIGVHAWQYQQSCMLISVECADDPGDSTWQQFTPSGPTRFPAAVRPLGLAGLVRRPGADPSAAEHDHGAAPAGDRQSLSGAAGTGDAAGGRRLPAHPASCAAVCSARPGAGGRCGAHHSSTGGAGG

SEQ ID NO: 13596 - protein, 112 aa, Klebsiella pneumoniae
QKFSTAARRHTSPRRGKTKTGVKIMKRAMIIASLGLASLLSFGASAAVQQVNAEQAQNLQSMGTISVSQVGSAPMDMRQELAAKAEKEGASSYRIIEARTGDSWHATAELYK

SEQ ID NO: 13597 - protein, 144 aa, Klebsiella pneumoniae
AVDSFCASVITMERRSAPIMILSFAFSNSTIDTTRLLPRAANSAASLTRLARSAPEKPGVPRAMIAASISGASGTRRICTFRICSRPRTSGRPTTTWRSKRPGRNSAGSRTSGRLVAAITMIPSLPSKPSISTSIWFRVCSRSS

SEQ ID NO: 13598 - protein, 423 aa, Klebsiella pneumoniae
RTESMDKFRVQGPTRLQGEVTISGAKNAALPILFSALLAEEPVEIQNVPKLKDIDTTMKLLSQLGAKVERNGSVWIDAGPVDVFCAPYDLVKTMRASIWALGPLVARFGQGQVSLPGGCAIGARPVDLHISGLEQLGAEIKLEEGYVKASVSGRLKGAHIVMDKVSVGATVTIMSAATLAEGTTIIENAAREPEIVDTANFLNALGAKITGQGSDRITIEGVQRLGGGVYRVLPDRIETGTFLVAAAISGGKILCRNAQPDTLDAVLAKLRDAGADIETGEDWISLDMHGNRPKAVNVRTAPHPGFPTDMQAQFTLLNLVAEGTGVITETIFENRFMHIPELIRMGAHAEIESNTAICHGVKQLSGAQVMATDLRASASLVLAGCIAEGTTIVDRIYHIDRGYERIEDKLQALGANIQRVKGE

SEQ ID NO: 13599 - protein, 120 aa, Klebsiella pneumoniae
QNLLEPYIVRGYSVSIAHVGRSGLLTPGEFMDKFIDWHPADIVAGLRKRGTSLAAESRRHGLSSSTLANALTRPWPKGELIIATALETQPWVIWPSRYHDPVTHEFIDRTQMMRQKKIDK

SEQ ID NO: 13600 - protein, 106 aa, Klebsiella pneumoniae
FRPPARTIRGDKISHSVLHWLSVQPSGLSRGNIMKKYLIVALLASLLAGCAHDSPCVPVYDSQGRLVHTNTCMKGTTEDNWETAGAIAGGAAAVAGLTLGIVALTR

SEQ ID NO: 13601 - protein, 620 aa, Klebsiella pneumoniae
EVNPLSDMAKNLILWLVIAVVLMSVFQSFGPSESNGRKVDYSTFLQEVNQDQVREARINGREINVTKKDSNRYTTYIPVNDPKLLDNLLTKNVKVVGEPPEEPSLLASIFISWFPMLLLIGVWIFFMRQMQGGGGKGAMSFGKSKARMLTEDQIKTTFADVAGCDEAKEEVGELVEYLREPSRFQKLGGKIPKGVLMVGPPGTGKTLLAKAIAGEAKVPFFTISGSDFVEMFVGVGASRVRDMFEQAKKAAPCIIFIDEIDAVGRQRGAGLGGGHDEREQTLNQMLVEMDGFEGNEGIIVIAATNRPDVLDPALLRPGRFDRQVVVGLPDVRGREQILKVHMRRVPLAPDIDAAIIARGTPGFSGADLANLVNEAALFAARGNKRVVSMVEFEKAKDKIMMGAERRSMVMTEAQKESTAYHEAGHAIIGRLVPEHDPVHKVTIIPRGRALGVTFFLPEGDAISASRQKLESQISTLYGGRLAEEIIYGPEHVSTGASNDIKVATNLARNMVTQWGFSDKLGPLLYAEEEGEVFLGRSVAKAKHMSDETARIIDQEVKSLIERNYGRARQLLNDNMDILHAMKDALMKYETIDAPQIDDLMARREVRPPAGWEEPGSFYKL

SEQ ID NO: 13602 - protein, 1279 aa, Klebsiella pneumoniae
CKTPRHCAADKERGVRRLPGILLLTVATLIVIVALLVSGLRLVLPQLDAWRPQLLEKISTLTGTPVDASQITASWQTFGPTLDARDIHVGLKDGGTMAVKRVTLALDVWQSLLHMRWQFRDLTFWQLQVHTNTPIQTNDGGESLKTDRISDLFLRQFDHFTLRDSHLSFLTLSGQRAELAVPQLTWLNGRNRHRAEGQLSLSSLTGQHGVMQVRMDLRDEDGLLNKGRVWLQADDIDVKPWLGRWMQDNIALKSARFSLEGWMTIEKGDVASGDVWLKKGGASWQGDNEVHHLSVDNLTAHLSHDKQSWAFYIPDTRIAIDDKPWPSGALAMAWIPAQDVGGDDRQRSDELRIRASNLALSGLSGLQPFADKLAPSLGELWRTTQPGGKINLLALDIPLQATEKTRFQAQWSDLAWKQWKLLPGAEHFSGSLNGSVEHGELRAHMAKALMPYAGVFRAPLEIAAGEATLSWVKNDKGFMLDGRDIDVQATGVRARGGFRYLQPQGDDPWLGILAGISTNDGGQAWRYFPENLMGKALVDYLSGAIKAGQASDATLVYGGNPHLFPYPHNEGQFQVYVPLKNATFAFQPDWPALTGLNIDLNFINNGLWMRADKAMLGNVTASNLDAAIPDYAQEKLLIDADIKGPGKEVGPYFNTTPLKESLGAALDSLQLDGDVSARLHLNIPLDGEMTTAKGDVRLQNNSLFIKPLDTTLQNLSGNFSFVNGDLNSQTLSATWFNQPLNLNFSTREGEKAFLVDVGMNANWQPSRTGLLPKAVSEALSGSVPWDGKVAIELPYHGNASYKVDINGDLKNVSSRLPSPVSKPAGEPLPVKINVAGGLSSFDLTGSIGAKNHINSRWLLNHKLTLDRAILTTDSKGYSPLPDQPGIELNLPPMDGAQWLALFENGAANEVSSNVLFPPRIVLRTPSLALAGQQWNNVSLMSQPVAGGSQVEAQGREINATLTMRDNAPWLANVRYLYFNPASASGQNATENVAPQTVTRLDFHGWPDLQLRCAECWLWGQKYGRIDGDVAIKGDTLTLSNGLVDTGFGRLTTNGVWVNAPSGVRTSLKGRLHGNKTDAFADFFGVSTPVKDSPFDIDYDLHWRAPPWSPDVASLNGIIKSHLGKGQFTDLSTGHAGQLLRLLSVDALLRKLRFDFSDTFSEGFYFDSINSTAWIKDGVLHTDDTLVDGLEADIAMKGSVDLVRRQLDLQAVVAPEISATVGVAAAFAVNPIVGAAVFAASKVLGPLWNKVSILRYRITGPIDQPQINEVLRQARSNKKQ

SEQ ID NO: 13603 - protein, 103 aa, Klebsiella pneumoniae
RSAPFLSFNFWSYKMSLSVEAKAKIVSEFGRGENDSGSTEVQVALLTAQINHLQGHFAEHKKDHHSRRGLLRMVSQRRKLLDYLKRKDVARYSALIERLGLRR

SEQ ID NO: 13604 - protein, 326 aa, Klebsiella pneumoniae
PSAFAEGVLRAGRLVCSRGTGRSSNRCLREWEMKPFLRWCFVATALTLAGCSSTAWRKDAVLAVPLQPTLQQEVILARMEQILASRALSDDERAQLLYERGVLYDSLGLRALARNDFSQALAIRPDMPEVFNYLGIYLTQAGNFDAAYEAFDSVLELDPTYNYAHLNRGIALYYGGRAKLAQDDLLAFYQDDPNDPFRSLWLYIAERKLDEKRALEALRERLNKSDKEQWGWNIVEFYLGDISEKELMTRLKADATDNTSLAEHLSETNFYLGKYYLSLGDKDSATALFKLAVANNVHNYVEHRYALLELSLLGQEQDDLAESDQQ

SEQ ID NO: 13605 - protein, 157 aa, Klebsiella pneumoniae
SAMPLMRCRSRFCVTTFASLPPVTAARTISSLSICRANTDIRVRDVLVTSGLGGRFPEGYPVGVVSSVKLDTQRAYTVIQARPTAGLQRLRYLLLLWGADRNGANPMTPEEVHRVANERLMQMMPQVLPAPDAMGPQMPAPATGLTPPQPSQPAGGQ

SEQ ID NO: 13606 - protein, 316 aa, Klebsiella pneumoniae
SWSPPPMALWPPTFVRWFVFPSACWWKRMASVSAAAAAVAGVLVMTISSPPRRATCGLMPGRKKRCAWRWSTSRRSPPLRGCCRWCSAPAGLASCCMKAVGHGLEGDFNRRGTSVFSGHMGELVASELCTVVDDGTIADRRGSVAIDDEGTPGQYNVLIENGILKGYMQDKLNARLMGVAPTGNGRRESYAHLPMPRMTNTYMLAGQSTPQEIIESVDYGIFAPNFGGGQVDITSGKFVFSTSEAYLIEKGKVTKAVKGATLIGSGIETMQQISMVGNDLRLDNGVGVCGKEGQSVPVGVGQPTLKVDNLTVGGTA

SEQ ID NO: 13607 - protein, 97 aa, Klebsiella pneumoniae
AKPPVIPAPKLTPVFPSTQTMPPVIYSQPLSPMPSTTVMAPELRTAKRSPARPAAYRRPPVAPYRQVLPIMLASWLRNAEPTGGRMASRPPAMPFPT

SEQ ID NO: 13608 - protein, 231 aa, Klebsiella pneumoniae
PMKPIFSRGPSLQIRLILAVLVALGVIIADSRLGTFSQIRTYMDTAVSPFYFVSNGPRELLDSVSQTLATRDQLELENRALRQELLLKNSDLLMLGQYKQENARLRELLGSPLRQDEQKMVTQVISTVNDPYSDQVVIDKGSVNGVYEGQPVISDKGVVGQVVAVAKMTSRVLLICDATHALPIQVLRNDIRVIAAGNGCTDDLQLEHLPGEYRYSRPRRAGDLRSRRSFP

SEQ ID NO: 13609 - protein, 163 aa, Klebsiella pneumoniae
LGYTPFFYVLGVGLSTLEQKLTEMLTAPVEALGFELVGIEFIRGRTSTLRIYIDSEDGINVDDCADVSHQVSAVMDVEDPITVAYNLEVSSPGLDRPMFTAEHYQRFTGEEVALVLRMAVQNRRKWQGIIKAVDGEMITVTVEGKDEVFALSNIQKANLVPHF

SEQ ID NO: 13610 - protein, 442 aa, Klebsiella pneumoniae
RLQTPSSRPIQMRYKSMSPTSDGSRFGRSSRSPRGPRSLRSPRPVEPIVTIAEFTTWTHRRVRRNDQRTFALSHLQQRSSQRFHVQLFTFRRRLDFRQQCTVLIQIAAFQLLLNFRGEFFQTTLAQQLRVRQFHFRNGQLHSAFDVAQQTTLAVLNEQQRAASTTGTTSTADTVNVGFRIHWDVVVHHQADTLNVQATGRNVSRNQDIQTTIFQAFQSLLTQRLVHVAVQRRAVVAITLQRFSYFQGRVFGTDEDNRRIKVFRFQETHQRFVFTHAVGSPVALADIRASRHAGLNAHFLRLFHKATGNATDSFRHGGGEQRGLMPFRDLRHNGFYVFDKAHAQHFICFIQYQAAQFGEVQGAALQVVQQTTRGTDDDLRTLTQGAQLHVITLAAVQGNHVHAAHMFREFRHCFSNLYRQLAGRRQHQNLRCSQLRIDVVQQR

SEQ ID NO: 13611 - protein, 147 aa, Klebsiella pneumoniae
AGRTLFTCHLTFPFGFIVLYCVKIDAVVWRYMGDGGRMTRFQSQRKQKNTMNLSTKQKQHLKGLAHPLKPVVMLGNNGLTEGVLAEIEQALGHHELIKVKIASEDRETKALIVEAIVRETGACNVQVIGKTLVLYRPTPERKISLPR

SEQ ID NO: 13612 - protein, 171 aa, Klebsiella pneumoniae
VCWTMSCEPQLTKRLGVHQRVTYYLGKLLMKTFTAKPETVKRDWYVVDATGKTLGRLATELARRLRGKHKAEYTPHVDTGDYIIVLNAEKVAVTGNKREDKMYYHHTGHIGGIKEATFEEMIARRPERVIEIAVKGMLPKGPLGRAMYRKLKVYAGNEHNHAAQQPQVLDI

SEQ ID NO: 13613 - protein, 221 aa, Klebsiella pneumoniae
LLHAAPSSVKWSKEAPAPGITPELRRYIGERCAKACVDIGYRGAGTFEFLFENGEFYFIEMNTRIQVEHPVTEMITGVDLIKEQLRIAAGQPLSIKQDEVVVRGHAVECRINAEDPNTFLPSPGKITRFHAPGGFGVRWESHIYAGYTVPPYYDSMIGKLICYGESRDVAIARMKNALQELIIDGIKTNVDLQMRIMSDENFQHGGTNIHYLEKKLGLQEK

SEQ ID NO: 13614 - protein, 107 aa, Klebsiella pneumoniae
IAAARSKKGAVRPLFLKLAELATQTQTLNQRRVTGNIFTFQVVEQFTTLRNHAQQTTTAVVIFFVLCKVALQVVDLCGQQCNLNFGRTAVVFATTKLRNDFCFSFNA

SEQ ID NO: 13615 - protein, 120 aa, Klebsiella pneumoniae
TPAALFGNDAEETIGFLQQQTATVAGFTIGKDCATVLHAGQCVYCGSHYLVARFAFYVGDQAETTVIPLKGFVVQHISEPPQALRTPSDTDCAQAQKEHGDGVYTSHSPSLNPFRIGTQV

SEQ ID NO: 13616 - protein, 462 aa, Klebsiella pneumoniae
KRCAWWKPPSPLREKNVMSNRKYFGTDGIRGRVGDAPITPEFVLKLGWAAGKVLARHGSRKIIIGKDTRISGYMLESALEAGLAAAGLSASFTGPMPTPAIAYLTRAFRAEAGIVISASHNPFYDNGIKFFSIEGTKLPDDVEEAIEAEMEKELTCVDSAELGKASRIVDAAGRYIEFCKGTFPNELSLGTLKVVVDCAHGATYHIAPNVFRELGAQVIAMGCEPDGLNINEEVGATDVRALQARVLAEKADLGIAYDGDGDRVIMVDHEGNKVDGDQILYIIAREGLRQGQLRGGAVGTLMSNMGLELALKQLGIPFARAKVGDRYVLEMLQEKGWRIGAENSGHVILLDKTTTGDGIVASLQVVAAMVRNHMSLHDLCSGMKMFPQLLVNVRFTEGSGNPLENEHVKAVTAEVEAALGKRGRVLLRKSGTEPLIRVMVEGEHEDQVHEFAHRIAEAVKSV

SEQ ID NO: 13617 - protein, 226 aa, Klebsiella pneumoniae
RYSATSRAFFSSRTTVTSSPAAGTPDRPRISTGMDGPASSTSRPSSSRIARTRPYSKPHRTMSPLCRVPSRTRTVATGPRPLSRKDSMTAPLAIPLRTAFSSRTSACSRIASSRSSMPVPAFAETWTNWLSPPHSSGRMPYWDSSFFTRSGSASGLSILFTATTTGTCAALACWIASIVCGITPSSAATTRTTISVACAPRARMEVNAAWPGVSRKVIMPLSVSTW

SEQ ID NO: 13618 - protein, 325 aa, Klebsiella pneumoniae
MLLATALLIIGLLLVVYSADRLVYAASILCRMLGIPPLIIGMTVVSIGTSLPEIMVATAASLHGQTDLAVGTALGSNITNILLILGLAALLRPFTVHSDILRRELPLMLLVSVLAGLVLYDGQLTRLDGLFLLALALLWLLFTIKIARLAERQGSDSLTREQLAELPREGSLPVALLWLGVAMIVMPMATRMVVDNSTVLANYFAISELTVGLTVVAIGTSLPELATAIAGARKGEDDIAIGNIIGANILNIALVLGLPALIAPGSFATEAFTRDYGVMLLVSLIFAVLCWRRQQQPGRLVGALLVGGFVVWLAMLFWTAPLFVE

SEQ ID NO: 13619 - protein, 1040 aa, Klebsiella pneumoniae
GYPAMSKFFIHRPVFAWVLAIIMMIAGGLAILQLPIAQYPTIAPPAVAISATYPGADAQTVQDTVTQVIEQNMNGIDNLMYMSSTSDSAGSVTITLTFKSGTDPDIAQVQVQNKLQLATPLLPQEVQQQGISVEKSSSSFLLVAGFISDNPTTTQDDISDYVASNVKDPISRLNGVGDVQLFGAQYAMRVWLDGNLLNKYNLTPVDVINALQVQNDQIAAGQLGGTPALKGQQLNASIIAQTRLKDPQEFGKVTLRVNADGSVVHLKDVARIELGGENYNVVARINGKPASGLGIKLATGANALDTATAIKAKLAELQPYFPQGMKVVYPYDTTPFVKISIHEVVKTLFEAIILVFLVMYLFLQNMRATLIPTIAVPVVLLGTFAVLSMFGYSINTLTMFGMVLAIGLLVDDAIVVVENVERVMVEEKLSPKEATEKSMSQIQGALVGIAMVLSAVFVPMAFFGGSTGAIYRQFSITIVSAMALSVLVALVLTPALCATLLKPASAEHHEKKGFFGWFNARFDQSVNHYTNSVSGILRGTGRYLVIYLLIVVGMAVLFMRLPTSFLPDEDQGVFLTMIQLPSGATQERTQKVLDTVTDYYLHNEKANVESVFTVNGFSFSGQGQNSGMAFVSLKPWEARSGDKNSVESIIKRATVAFSQIKDAMVFPFNMPAIIELGTATGFDFELIDQGGLGHTALTQARNQLLGMVKQHPDQLVRVRPNGLEDTPQFKLDVDQEKAQALGVSLSDINETISAALGGYYVNDFIDRGRVKKVYVQADAHFRMLPSDINNMYVRSANGEMVPFSAFVTSRWIYGSPRLERYNGLPSMEILGEASPGKSTGEAMALMETLASKLPSGIGYDWTGMSYQERLSGNQAPALYAISLIVVFLCLAALYESWSIPFSVMLVVPLGVIGALLAATLRGLNNDVYFQVGLLTTIGLSAKNAILIVEFAKDLMEKEGKGIIEATLEASRMRLRPILMTSLAFILGVMPLVISHGAGSGAQNAVGTGVMGGMLTATLLAIFFVPVFFVVVRRRFTRHAE

SEQ ID NO: 13620 - protein, 222 aa, Klebsiella pneumoniae
PGKAALEMFEPGEYVLVLLDIQLPDMTGLDISRELKQRFAADELPPLVALTADVLKNKKEYFDAGMDDVLSKPLSVPALTAMIKKFWDAPDEEAQEAPAADLHKAEAVLDTDMLEQYIELVGPKLINDGLAVFEKMMPGYMSVLESNLTARDQKGIVEEGHKIKGAAGSIGLRHIQQLGQQIQTPDLPAWSDNVAEWVEEMKSEWQNDVAVLKAWVAKASKK

SEQ ID NO: 13621 - protein, 243 aa, Klebsiella pneumoniae
SVMATLTAKNLAKAYKGRRVVEDVSLTVNSGEIVGLLGPNGAGKTTTFYMVVGIVPRDAGNIIIDDEDISLLPLHARARRGIGYLPQEASIFRRLSVYDNLMAVLQIRDDLTSEQREDRAKELMEEFHIEHLRDSLGQALSGGERRRVEIARALAANPKFILLDEPFAGVDPISVIDIKRIIEHLRDSGLGVLITDHNVRETLAVCERAYIVSQGHLIAHGTPQQILEDEQVKRVYLGEDFRL

SEQ ID NO: 13622 - protein, 114 aa, Klebsiella pneumoniae
PPAAGQKWSTAGRPGGSPFSPQPLRKPGSPPAENKPGSPAASDHPPRYIWQTGSAPPPAVPAPSPARRSRLNSQAPPSPRLPAAYRYLSSQTPSSASHPAGRSSYPSSSSRKPA

SEQ ID NO: 13623 - protein, 280 aa, Klebsiella pneumoniae
SSAAARARVNPSLCERWKIWAFHCVDNLPVVLLPDLARSLADRNISAAVSIDVRNMPESPEIFEQAMQNLPECFSPQLLFLDADRNTLIRRYSDTRRLHPLSSKNLSLESAIDEESDLLEPLRSRADLIVDTSEMSVHELAEMLRTRLLGKRERELTMVFESFGFKHGIPIDADYVFDVRFLPNPHWDPKLRPMTGLDKPVAAFLDRHTEVHNFIYQTRSYLELWLPMLETNNRSYLTVAIGCTGGKHRSVYIAEQLADYFRSRGKNVQSRHRTLEKRKS

SEQ ID NO: 13624 - protein, 197 aa, Klebsiella pneumoniae
GQRAINMSKTRRWVIILLSLLALILIGLNLANTDDTAQPEVNPNDPTYKSEHTDTVVYSPEGALSYRLIAEHVEYFSDQEVSWFTKPVMTTFDTNKVPTWSVRADKAKLTNDRMLYLYGHVEVNALAPDSQLRKITTDNAQINLVTQDVTSDDMVTLYGTTFNSSGLKMRGNLRSKNAELIEKVRTSYEIQNKQTQP

SEQ ID NO: 13625 - protein, 63 aa, Klebsiella pneumoniae
SNCYSLKTVMPKLTIDEKKAVLHYAMIRQDSTSVELAVIVALSGAGGEPKSHPTEPQYNGRCS

SEQ ID NO: 13626 - protein, 145 aa, Klebsiella pneumoniae
EPPYGTTIQREMFMTWEYALIGLVVGIIIGAVAMRFGNRKLRQQQALQYELEKNKAELEEYREELVSHFARSAELLDNMAHDYRQLYQHMAKSSNNLLPDSMADANPFRNRLEESEASNDQAPVQMPRDYSEGASGLLRGGAKRD

SEQ ID NO: 13627 - protein, 107 aa, Klebsiella pneumoniae
TGLFSFSLSSSIPCGTIPAFFILKGQKMDKRFVQAHKEARWALWLTLLYLAAWLAAAYLPGVAIGFTGLPHWFEMACLLVPLLFILLCWAMVKLIFRDISLEDDDAV

SEQ ID NO: 13628 - protein, 115 aa, Klebsiella pneumoniae
TDAQASVFLSLYLTATEREAGGAVMTTYTFDFDEIAEQQDFYREFSRTFELAQDKVNNLDSLWDAVTGGLLPLPLDIEFIHLNDKQRRRFGALILLFDEAEEELEGELRFNARQA

SEQ ID NO: 13629 - protein, 170 aa, Klebsiella pneumoniae
NACHNHTKQRVRNPLMDIRKIKKLIELVEESGISELEISEGEESVRISRSAPAASYPVMQQAYAAPMMQPQAPAAATAAPAAAAEAPAKAEISGHIVRSPMVGTFYRTPSPDAKAFVEVGQKVNVGDTLCIVEAMKMMNQIEADKAGVVKAILIESGQPVEFDEPLVVIE

SEQ ID NO: 13630 - protein, 336 aa, Klebsiella pneumoniae
RLIQVIAVGDEKWQAWPPLLRAVYQIMQLQKLVNMFGGDLMRRYGEKVHKLTLHGGFSCPNRDGTLGRGGCTFCNVASFADEAQQHRSIAEQLAHQAQLVNRAKRYLAYFQAYTSTFAEVQVLRSMYRQAVSAANIVGLCVGTRPDCVPQAVLDLLSEYHQQGYEVWLELGLQTAHDKTLHRINRGHDFACYQRTARLARERGLKVCAHLIVGLPGESQGHCLQTLEQVVATGVDGIKLHPLHIVKGSIMAKAWQAGRLDGIELEAYTVTAGEMIRHTPPEVIYHRISASARRPTLLAPLWCENRWTGMVELDRYLNQQGAQGSALGRSWVAPQAE

SEQ ID NO: 13631 - protein, 353 aa, Klebsiella pneumoniae
HIRHSSPSPSCLGKRMTEDTMKRKKLTEADVTAESVFMLKRRQMLKMLGISATALSLPAAAQADLLDWFKGHDRPPAPAGKALEFAKPAEWQANLTLTPEDKVAGYNNFYEFGLDKADPAANAGSLRTDPWTLTIGGEVAKPLTLDHDDLTKRFPLEERIYRMRCVEAWSMVVPWVGFPLHKLLALVEPTSSARYVAFKTLYAPDQMPGQKDRFIGGGLAYPYVEGLRLDEAMHPLTLLTVGVYGKALPPQNGAPVRLTVPWKYGFKGIKSIVSIELTRERPPTTWNLAAPDEYGFFANVNPHVDHPRWSQASERFIGAGGVLDVKRQPTLLFNGYADEVASLYRGMNLRENF

SEQ ID NO: 13632 - protein, 117 aa, Klebsiella pneumoniae; identical to SEQ ID NO: 8757

SEQ ID NO: 13633 - protein, 434 aa, Klebsiella pneumoniae
YNEHGVIMGKNIRWIIVLLLFLVYMINYLDRVALSITVPMIEKDLALNAEQFGIIFGSFFFGYAVFNFIGGLAVDKFGATLVMGLAVGLWSLFCGLTAVATGFYSMLVLRVLFGMAEGPICASANKMINGWFPKKQAATAVGFLSAGSPLGGAVAGPIVGYLALAFGWRPAFMIIFAIGIVWMIAWFFIAANSPEKHKKVSQEELKLINKMKEEEVALETIENQTAHSLGYYLKQPIILVTAFAFFCYNYILFFFLSWFPSYLVQQHHLDIKQMSLTTMIPWIVGFVGLALGGYISDKIFKLTGRLLLSRKIVLVVCLLMAAICVGLAGTVSSVVPAVLLMSVSIFFLYVTGAIYWAIIQDVVHKSRVGGASGFIHLIGSVSGIVGPIVTGYIVQSTGKFDSAFVLAGTIAALGALLVLFVIKTPRVTMKASQA

SEQ ID NO: 13634 - protein, 360 aa, Klebsiella pneumoniae
PFINDICIMPGKLLRSVLIGLLVGGLLLALMPSLRQWQLAPTTQNDTADDSPASYNAAVRRAAPAVVNVYNRALNSTSHNQLTLGSGVIMDQRGYILTNKHVINDADQIIVALQDGRVFEALLVGSDSLTDLAVLKINATGGLPVIPINPKRTPHIGDVVLAIGNPYNLGQTITQGIISATGRIGLNPTGRQNFLQTDASINHGNSGGALVNSLGELMGINTLSFDKSNDGETPEGIGFAIPFQLATKIMDKLIRDGRVIRGYIGISGREIAPLHAQGGGIDQIQGIVVNDVAPDGPAAQAGIRANDVIISVNDKPAVSALETMDQVAEIRPGSEIPVVIMRDDKKITLHIAVQEYPATN

SEQ ID NO: 13635 - protein, 189 aa, Klebsiella pneumoniae
NNTNCPGPLAPAAGYHRRRARGRSGEIMMNNDSALQLSNVLNQECTRSQVHCQSKKRALEIISELAAKQLSLPPQVVFEAILTREKMGSTGIGNGIAIPHGKLEEDTLRAVGVFVQLETPIAFDAIDNQPVDLLFALLVPADQTKTHLHTLSLVAKRLADKAICRRLRAAQSDEELYEIITEAGSSDDA

SEQ ID NO: 13636 - protein, 298 aa, Klebsiella pneumoniae
INHNKEFRMKVAVLGAAGGIGQALALLLKTQLPSGSELSLYDIAPVTPGVAVDLSHIPTDVKIKGFSGEDATPALEGADVVLISAGVARKPGMDRSDLFNVNAGIVKNLVQQIAKTCPQACIGIITNPVNTTVAIAAEVLKKAGVYDKNKLFGVTTLDIIRSNTFVAELKGKSATEVEVPVIGGHSGVTILPLLSQIPGVSFSDQEIADLTKRFQKRPYPKSWETKNGRGGRATLFNGAKGGGPFWSLSGSRHAGGKRRGGVRLRGRRRPLCAFLLPAAAAGEKRRGRATVYRQTQRL

SEQ ID NO: 13637 - protein, 85 aa, Klebsiella pneumoniae
MAHKKAGGSTRNGRDSEAKRLGVKRFGGEAVLAGSIIVRQRGTKFHAGTNVGCGRDHTLFALTDGKVKFEVKGPKNRKFISIVAE

SEQ ID NO: 13638 - protein, 85 aa, Klebsiella pneumoniae
LHNKRICSLPVRFLFKVIMSLFPVIVIFGLSFPPIFFELLLSLAIFWLVHRLLVPTGIYDFVWHPALFNTALYCCLFYLISRLFV

SEQ ID NO: 13639 - protein, 719 aa, Klebsiella pneumoniae
FIDKKDRILLNPIVRKFQYGQHTVTLETGMMARQATAAVMVSMDDTAVFVTVVGQKKAKPGQDFFPLTVNYQERTYAAGKIPGGFFRREGRPSEGETLIARLIDRPVRPLFPEGFVNEVQVIATVVSVNPQVNPDIVAMIGASAALSLSGIPFNGPIGAARVGYINDQYVLNPTQEELKSSKLDLVVAGTEAAVLMVESEAELLSEDQMLGAVVFGHEQQQIVIQNINDLVKEAGKPRWDWQPEAVNEALNARVAALAESRLSDAYRITDKQERYAQVDVIKSETIATLVAEDETLDANELGEILHAIEKNVVRSRVLAGEPRIDGREKDMIRGLDVRTGVLPRTHGSALFTRGETQALVTATLGTARDAQNIDELMGERTDSFLFHYNFPPYSVGETGMVGSPKRREIGHGRLAKRGVLAVMPTIEEFPYTVRVVSEITESNGSSSMASVCGASLALMDAGVPVKAAVAGIAMGLVKEGDNFVVLSDILGDEDHLGDMDFKVAGSRDGISALQMDIKIEGITKEIMQVALNQAKGARLHILGVMEQAINAPRGDISEFAPRIHTIKINPDKIKDVIGKGGSVIRALTEETGTTIEIEDDGTVKIAATDGDKAQHAIRRIEEITAEIEVGRIYNGKVTRIVDFGAFVAIGGGKEGLVHISQIADKRVEKVTDYLQMGQEVPVKVLEVDRQGRVRLSIKEATEQTPSAAAPEAPAAEQGE

SEQ ID NO: 13640 - protein, 353 aa, Klebsiella pneumoniae
KYRNLFRKKTMEGIKMRSVVVKEPGQLNIESRPVPVPGAHEVRVKIAFAGICGSDVHIYHGHNPFAKYPRVIGHEFYGIIDAVGEQVSPARIGERVAVDPVVSCGHCYPCSVGRPNVCTQLQVIGVHRDGGFSDYACVPAKNAWRIPEAISDRQATMVEPFTIAANITAQLQPTAQDIALVYGAGPMGLTIIQALKGVYGVKQVIVVDRIAERLQMARENGADLTLDNTDQPLAEQLAQRQLAPTLVIDAACHPAILQEAILLASPAARIGILGFSGEASTLTQQSITSKEISIFSSRLNSGRFPLVIDWMEKGLIRPEALITHCMPLEHVKEAMEIFANDRKTCCKVLLQLG

SEQ ID NO: 13641 - protein, 244 aa, Klebsiella pneumoniae
  UNSURE (212),(220),(238): Identity of amino acid at the above locations are unknown.
LSSNEANMLDKIVIANRGEIALRILRACKELGIKTVAVHSTADRDLKHVLLADETVCIGPAPSVKSYLNIPAIISAAEITGAVAIHPGYGFLSENANFAEQVERSGFIFIGPKADTIRLMGDKVSAITAMKKAGVPTVPGSDGPLTDDMDANRAHAKRIGYPVIIKASGGGGGRGMRVVRSDAELAQSISMTKAEAKSAFNNDMVYMEKYLXNPRHIEIXVLADVQGNAIYLAERDCXMQRRHQ

SEQ ID NO: 13642 - protein, 209 aa, Klebsiella pneumoniae
MTGKKRSASSSRWLQEHFSDKYVQQAQKKGLRSRAWFKLDEIQQSDKIFKPGMTVVDLGAAPGGWSQYAVTQIGNSGRIIACDLLPMDPIVGVDFLQGDFRDELVLKALLERVGDSKVQVVMSDMAPNMCGTPAVDIPRAMYLVELALEMSRDVLAPGGSFVVKVFQGEGFDEYLREIRSLFTKVKVRKPDSSRARSREVYIVATGRKP

SEQ ID NO: 13643 - protein, 173 aa, Klebsiella pneumoniae
IKILSWLKRRAASLKKNFSLRPCRLSAGAMCRPTKAYSVKSPSPRCPVLSKSLSTPRLAGARAIWSAVCLLRVVALKNVCRKTKISTFVACPIWSTSIKVCVCRRICRASTWTSRTCAWSRLSACSTSASPPTPYHAGRWRSRSATWRTTVKLTPLPATASGPAPVPISSRPR

SEQ ID NO: 13644 - protein, 173 aa, Klebsiella pneumoniae
KGDKGALKVYVVFYPKMAGDRHTMAVKFHILLLNGPNINMLGTREPEKYGPLTLAEIVNRLTSEAAALNVSLDHLQSNAEHALIDRIHQAKDNVDYILINPAAFTHTSVAIRDALLAVNIPFIEIHLSNVHAREPFRQHSYLSDVAAGVICGLGADGYSYALQTAVKRLSQSH

SEQ ID NO: 13645 - protein, 91 aa, Klebsiella pneumoniae
TNVKSPATCCGAFIRYRDAKNLFSNDADEFTVFRAFNFELDFTVSQSEQSVVTAATNVGTSVEFSTTLTNDDATCQNCFTAETFYAQTFSF

SEQ ID NO: 13646 - protein, 476 aa, Klebsiella pneumoniae
GIGNRFDRTLYVRLQYDVHFVNFAFGHVSEHVFQFRFLLTRQLNFTEFALTIQRHFTRFFLVTHYGHFITGSRHTGQAEDFHRNGRTRFQHFATQFVTHRAHTAIFEAAQNNVALMQSTFANQNGSYRTTTFIKEGFDDRAARHTVADRFQLKNFSLQQDRVQQVVDAGTRFRGNVDKLALAAPLFRQDAVLGQFVLHAIRIGFWLIDLVHRHYHRYLRRFSVLDSFDSLRHHAVVCRHHQNHDIRRLRATSTHGGKRGVARGIQEGDHAVVGFDVVSTDVLGNTTRFAGGNLGRTNVVQQRGFTVVNVTHNGHDRCARFSRRAGVTVAHYGFFQFVFTTQDNFVAHLFGNQLCGFLVDDLVDGRHGAQLHHRFDDLRTFHRHLVSQFANGDGFADYDVTVNGLRWLLEALLQSGTFTVLTAFTAAHGRAGFFTISFRFSVFVAFLRRTSRFAATATAATAFDFTIVIIFSLTSML

SEQ ID NO: 13647 - protein, 118 aa, Klebsiella pneumoniae
RTLNHIKRCAEAEFYMYAVFQSGGKQHRVSEGQTVRLEKLDIATGEAVEFAEVLMIANGEEIKIGVPFVEGGVIKAEVVAHGRGEKVKIVKFRRRKHYRKQQGHRQWFTDVKITGISA

SEQ ID NO: 13648 - protein, 217 aa, Klebsiella pneumoniae
FQEKYDMFKRLLMVAMLVIAPLTAVQAADQSNPYKLMNEAAQKTFDRLKNEQPKIKANPNYLRDIVDQELLPYVQVKYAGALVLGRYYKEATPAQREAYFAAFREYLKQAYGQALAMYHGQTYQIAPEQPLGSATIVPIRVTIIDPNGRPPVRLDFQWRKNTQTGNWQAYDMIAEGVSMITTKQNEWSDLLRTKGVDGLTAQLKAISAQPITLEQKK

SEQ ID NO: 13649 - protein, 203 aa, Klebsiella pneumoniae
RTSDADDAAGTACAGCDGAADAGARHRVDAASAVAACRGAIVASYRSQGRWVIWLSFLIALLLQIMPWPADISVFRPNWVLLILLYWILALPHRVNVGTGFVMGAILDLISGSTLGVRALSLSIVAYLVALKYQLFRNLALWQQALVVMLLSLAVDIIVFWAEFLVINVSFRPEVFWSSVVNGILWPWLFLLMRKVRQQFAVQ

SEQ ID NO: 13650 - protein, 123 aa, Klebsiella pneumoniae
LHPEGESAPEHGIYPLILFSIKNSHTLQGIPHSLEAIEFAVSRPLLRSKGLDRQRMDAVVGNIFHQRRVDALLLFHPTHAIEHLTHSNNLKVAAIARDVDFLEGECVHQHGLNFMIFHGLKFI

SEQ ID NO: 13651 - protein, 74 aa, Klebsiella pneumoniae
LNPEIAMAIWNTFRKNSFKFGYEGHLVLTVYLKKYLMGKWLRGPDLNRRPSGYEPDELPGCSTPRLKRGIFYSF

SEQ ID NO: 13652 - protein, 131 aa, Klebsiella pneumoniae
AMAENQYYGTGRRKSSAARVFIKPGNGKIVINQRSLEQYFGRETARMVVRQPLELVDMVEKLDLYITVKGGGISGQAGAIRHGITRALMEYDESLRSELRKAGFVTRDARQVERKKVGLRKARRRPQFSKR

SEQ ID NO: 13653 - protein, 342 aa, Klebsiella pneumoniae
SFCDPTWIHGNRTFGPAFAMNLEKINELTAQDMAGVNATILEQLNSDVQLINQLGYYIVSGGGKRIRPMIAVLAARAVGYQGSAHVTIAALIEFIHTATLLHDDVVDESDMRRGKATANAAFGNAASVLVGDFIYTRAFQMMTQLGSLKILEVMSEAVNVIAEGEVLQLMNVNDPDITEENYMRVIYSKTARLFEAASQCAGLLADCTAEEERALQDYGRYLGTAFQLIDDLLDYSSDGERLGKNVGDDLNEGKPTLPLLHAMHHGTPDQSAMIRGAIEQGNGRHLLDAVLETMATCGSLEWTQKRAEEEADKAIAALQILPDTPWREALIGLAHIAVQRDH

SEQ ID NO: 13654 - protein, 326 aa, Klebsiella pneumoniae
ASCEPGRQQGGLMSRPRRRGRDVHGVLLLDKPQGASSNDVLQKVKRIYNANRAGHTGALDPLATGMLPICLGEATKFSQYLLDSDKRYRVIAKLGQRTDTSDADGQVVEERPLTFSDEQLAAALDSFRGETQQVPSMYSALKYQGKKLYEYARQGIEVPREARPITVYELLFIRREGDELELEIHCSKGTYIRTIIDDLGEKLGCGAHVIFLRRLAVSKYPVERMVTLEQLQALVDEAAAQDIPAAQLLDPLLMPMDSPASDYPLVNIPETSAVYFKNGNPVRQSGAPLDGLVRVMESESGKFLGMGEIDDEGRVAPRRLVVEYPA

SEQ ID NO: 13655 - protein, 323 aa, Klebsiella pneumoniae
IPRLLLKAMDALPPTRILDRDDMMHIGICSFRSGQSAAQVMEHAEAATRNAVLQGSNSWSVYDDTLPEKGRGNVRWRTLIEQMLSRGGPRLYQKPAVTRDGRVHHRELMSRMYDGKEEVIAAEYMPMVLQFGLVEEYDRLQVTRLLPFLGFWPEENLALQLSVESLIRPRFQRWLRDALMQCEKSQRQRIIFELAEADVCQYIGRLQPVMRLVNALGVRVAVVQAGLTLVGTSWIKQLDAELIKLHPGLARNIEKRSENQLLVQSLVEACKGMPMQVFATGVRSRSEWLVLSQCGVTGGQGEFFAASQPLDTNVKKYSQRYSV

SEQ ID NO: 13656 - protein, 218 aa, Klebsiella pneumoniae
IYLEVFMAVAANKRSVMTLFSGPTDIYSHQVRIVLAEKGVSFEIEHVEKDNPPQDLIDLNPNQSVPTLVDRELTLWESRIIMEYLDERFPHPPLMPVYPVARGESRLYMQRIEKDWYSLMNTIQSGTAAQADAARKQLREELLAIAPVFTQKPYFLSDEFSLVDCYLAPLLWRLPVLGVELVGAGAKELKGYMTRVFERDSFLASLTEAEREMRLGRG

SEQ ID NO: 13657 - protein, 484 aa, Klebsiella pneumoniae
SQADVLTVTADRLRQVARFYRDIHGVFIFIHHDGRDVCRRHSVNHELRRVIIPQDDIDAFTPQLSRHGLHTRTAHTDASANRVDALVVGFHRDFGTRARIASRRFDLQHFFTDFRHFDAEQFDQHLRFGTGDEQLGATRFRTDSVQYAANAVARTEVFTRQHIFTQDHGFSVVTQIQCDIVAVHFFHHAGDDLTFVLAELIDHHRALGFADFLHDNLLSGLGGDTVEGNRFDLIFDIVADVHAFIFETRCFQRDLARRLGDFFYNQPTTEGIEIAALAVDFNANVDLLFVFFLGGRCQRAFQRFENFLTRQRFFVGNGFNNSQNFFVHRGLSPQSRLLKVGNQVRLLDVTQREHFIFAFDGYRDHLTVYRFDNALPFAAVLNRHAQHQRNFFAGETLIVFGGEHRTVKTRRRDFQVVSDSDRVFDIHDGAYLVAHISTIINVDAIFTINIDAQCGCATANKFDADQLKAKRFNRRSEHLCQFLL

SEQ ID NO: 13658 - protein, 334 aa, Klebsiella pneumoniae
MIRDNIMSQIDLPTDFDFQQAGRQVLEIEREGLAQLDQYINEDFTHACETIFRCGGKVVVMGMGKSGHIGRKMAATFASTGTSAFFVHPGEAAHGDLGMVTPQDVVIALSNSGESNEILALIPVLKRQQVKLICITSRPESSMARAADIHLCVKVPKEACPLGLAPTSSTTAALVMGDALAVALLEARGFTAEDFALSHPGGALGRKLLLRVNDIMHTGDEIPHVGLQATLRDALLEITRKNLGMTAICDDDMNIIGIFTDGDLRRVFDTGVDMRDASIADVMTRGGIRIRPGTLAVDALNLMQSRHITCVLVADGDHLLGVVHMHDLLRAGVV

SEQ ID NO: 13659 - protein, 162 aa, Klebsiella pneumoniae
AAGEAKRHPAIILKRGFWPLFCLYSGELIMAKEFGRPQRVAQEMQKEIAIILQREIKDPRLGMMTTVSGVEMSRDLAYAKVYVTFLNDKDEAAVKAGIKALQEASGFIRSLLGKAMRLRIVPELTFFYDNSLVEGMRMSNLVTSVVKHDDERRVNPDDSKED

SEQ ID NO: 13660 - protein, 298 aa, Klebsiella pneumoniae
IKSFAMPWIQLKLNTTGANAEDLSDALMEAGSVSITFQDTHDTPVFEPLPGETRLWGDTDVIGLFDAETDMKAVVAQLEQHPLLGAGFAHKIEQLEDKDWEREWMDNFHPMRFGERLWICPSWRDVPDENAVNVMLDPGLAFGTGTHPTTSLCLQWLDGLDLNGKTVIDFGCGSGILAIAALKLGAAKAIGIDIDPQAIQASRDNAQRNGVSERLELYLPQDQPESMKADVVVANILAGPLRELAPLISVLPVSGGLLGLSGILASQAESVCEAYADLFALDPVVEKEEWCRITGRKN

SEQ ID NO: 13661 - protein, 105 aa, Klebsiella pneumoniae
SAILSTSGTSCETTMQVTPSVLLSSEISFTSTPIVMGSCPTNGSSNIIRSGSRAMALARAARRAIPPESSEGINFAAPRSPTASSFIITVVCSSAGGKCVCSRSG

SEQ ID NO: 13662 - protein, 319 aa, Klebsiella pneumoniae
YRACSFEVDVKTLTRNILRTAITVILVILAFVAIFRAWVYYTASPWTRDARFSADIVAIAPDVSGLISQVNVKDNQLVKKDQVLFVIDQPRYQKALAQAEADVAYYQTLAQEKRVEAGRRNKLGVQAMSREEIDQANNVLQTVEHQLAKAVASRDLARLDLERTVIRAPADGWVTNLNVYTGEFITRGSTAVALVKENTFYVMAYLEETKLEGVRPGYRAEITPLGSSKTIKGTVDSIAAGVTNASSSSDSKGMASVDSNLEWVRLAQRVPVRIRLDHQQGNLWPSGTTATVVITGQEDRDTSQANFFQKLAMRLREFG

SEQ ID NO: 13663 - protein, 255 aa, Klebsiella pneumoniae
YARCQHCRRHDPGRYPHPPRHSGGGCAKPDAIPSYHLRAGCRWRPSAGCGTYARSAARGRSVSKEKIMNNADAQLATCYGPVSQAFVDRAAKIRLLILDVDGVLSDGLIYMGNHGEELKAFNVRDGYGIRCALTSGIEVAIITGRKAKLVEDRCQTLGITHLYQGQSDKLLAFRDLTDKLHVRPEEVAYIGDDLIDWPVMAEVGLSVAVADAHPLLLPRTNYVTRINGGRGAVREVCDLLLLAQGKLDEAKGQSI

SEQ ID NO: 13664 - protein, 578 aa, Klebsiella pneumoniae
VLLCGVVVKESPMKQIRMLAQYYVDLMMKLGLVRFSMLLALALVVLAIVVQMAVTMVLHGQVESIDVIRSIFFDLLITPWAVYFLSVVEQLEESRQRLSRLVDKLEEMRERDLKLNVQLKDNIAQLNQEIGEREKAEAERETTLEQLKIEMKEREETQIQLEQQSSFLRSFLDASPDLVFYRNEDKEFSGCNRAMELLTGKSEKQLIHLKPQDVYSEEAAEKVLETDEKVFRHNVSLTYEQWLDYPDGRKACFEIRKVPYYDRVGKRRGLMGFGRDITERKRYQDALERASRDKTTFISTISHELRTPLNGIVGLSRILLDTELTSEQEKYLKTIHVSAVTLGNIFNDIIDMDKMERRKVQLDNQPVDFTSFLADLENLSGLQAQQKGLRFVLEPSLPLPHKVITDGTRLRQILWNLISNAVKFTPQGGGVNVRVRYDEGDILHFEVEDSGIGIPEAEQDKIFAMYYQVKDSHGGKPATGTGIGLAVSRRLARNMGGDISVTSQPGKGATFTLTVHAPAIAEEVGRYAWRKTTCHVRRSTCCWLRTLSSTLLWPVQCWEKLGNSVDVAMTRESGVGDV

SEQ ID NO: 13665 - protein, 207 aa, Klebsiella pneumoniae
CVKCVSNLQCNKVDMTTLYLASGSPRRQELLTQLGLAFERLVPGIEEQRQPQESAQHYVVRLAREKAQAGVAMATRDLPVLGADTIVILNGEVLEKPRDAEHAAAMLRLLSGHTHQVMTAVALADKQQTLDCLVVTEVTFRRLSEQDIADYVASGEPLDKAGAYGIQGLGGCFVRKINGSYHAVVGLPLVETYELLSNFNSLRKGKG

SEQ ID NO: 13666 - protein, 83 aa, Klebsiella pneumoniae
QRIRRLYSPGSWSLYLGRDRTAGLWPVRPRPRRDLPERTLGGVKQALIPLLIPLFCGWFASAAGRRIDSCPHFLHNLQRIAQN

SEQ ID NO: 13667 - protein, 331 aa, Klebsiella pneumoniae
SFTRGVNTGMRLTTKFSAFITLLTSLTIFVTLIGASLSFYNGIENKVENRVQAVATMLDNRLITTSFDKLEPQLDELMTPIEIVHIDFMLNGKPLYSHSRPDSYRPLGSHEQFREITVPSLKHPGITLHLVYVDPMVNYFRSLSITAPLSISIGFMVVIIFFAVRWIRRQLAGQELLELRSTRILSGERGPQVRGSVYEWPASTSSALDMLLSELQFASDQRSRMDTLIRSYAAQDSKTGLNNRLFFDNQLATLLEDQEKVGAYGIVMMIRLPEFDLLRDNWGRAAAEEHYFTLINLLSTFIMRYPGALLARYHRYDFAVLLPHPTLKEAD

SEQ ID NO: 13668 - protein, 77 aa, Klebsiella pneumoniae
RFARREHPVYRDSPEQCACTRTLPPALVSVRCRRWRHLRAGGGWLFIRFTDGGKTPVTITLNKEYGTHSWIFVRLKN

SEQ ID NO: 13669 - protein, 144 aa, Klebsiella pneumoniae
LLNRDRYESSRQPFYVPFKSTPQVLGADASDFHISEPLTMALLLTIVFTTTKLNDFNFLATTVSNNFSFDYAALNERNADLDFFTVCDHQHFSEFNSFASCDVQLFQANGLTFAYSVLFTTTLENRVHIKLRFRAPLYVIQSAL

SEQ ID NO: 13670 - protein, 780 aa, Klebsiella pneumoniae
NALRKSGGLTATLLALLGSRSFRRCGRRSLFSCFFNAQTDTALAVNFQNLNRYFLTHLQVVSHFLNALVSDLRDVNQTFFTAADGNECAKINDTGHFTIVDAANFDLSGDLFDTTDSMLRFVAVGRCDLHGTVIFDLDGSTGLFGQGTDNRTAFTDNVFDLVRVDLDGVDTRCEFRDIAARRVNRLLHHAQDVQTRTFSLVQCNLHDFFGDTFNFDIHLQRRDTVAGTRNFEVHIAEVVFVTEDVRQHDEVVAFFHQTHCDTRHSGFYRHAGVHQRQRGAADGSHGRGTVRFGDFRYHAHGVREFFNSRHHGQYAALRQTTVTDFTTLRRPHHASFAYGVRREVVVEQEGVGALAHQFVDVLRITCGTQSRGNQRLRFATGEQRGTVSTRQNAGTNVQTTDHIFFTAIDTRLAGQYAATNHVFLDGMQDFTQLVSVQGFIFSNQRGDGFRFDHVNLSVTLLFVGDTVSIAQTGFSQRSHARVQRFVDRFRLPVPTRFTGFFHQVVDVLNNNLLLLVAEDHRAQHLVFAQQFRFGFHHQHGRFGTGNHQVQFAGLQFFLGWVQYVLVVDVTHARSADWAIERNTRQRQRSGSTDHRDDVWVNLRVNGNDGGDNLNFVNEAFREQRANRAVNQTRDQGFAFAWTAFTTEETTRDFTGSVGTLLVVNGQREKVLAWLRFFLTHNGNEYRSVIHANHHSGRCLARHHAGFQGHGMLAVLEFTNDRIKQNSILFIYKSRHIHDIASIDPIFCILATNDNLYPPLRMKPLISRANLCMKIITSNNT

SEQ ID NO: 13671 - protein, 117 aa, Klebsiella pneumoniae
WPDRAAESDLCAADHPGTEKIMSGQLSWTREGETLALHGELDQDLLVPLWEARAQATAGTAIIDLSQTTRVDTAGLALLVHFVALIRRQGREAQLVGKSENLQTLIGLYNLPADLIS

SEQ ID NO: 13672 - protein, 222 aa, Klebsiella pneumoniae
WLCRRSGVAVSRHESAGELLVRFTVKQIVWLKVLLHLAGFLPLVWLFWAGHQGYFSADPAKDIQHFTGRMALKFLLATLLVSPLARYAKQPLLIRVRRLLGLWCFAWATLHLTSYTLLELGINNLALLGSEIITRPYLTLGMISWAILLALAVTSTQAMQRKLGRRWQLLHNFVYLVAILAPIHYLWSVKIVSPQPVIYALLAAGLLTWRYKKFRQWWRAIR

SEQ ID NO: 13673 - protein, 130 aa, Klebsiella pneumoniae
NVPLYWSKHLVCGESARNRLIMYEALLVVFLIVAIGLVGLVMLQQGKGADMGASFGAGASGTLFGSSGSGNFMTRMTGILAALFFIISLALGNINSNKTSKGSEWDNLSAPKTEQTQPTAPAQPTSDIPH

SEQ ID NO: 13674 - protein, 310 aa, Klebsiella pneumoniae
IMERLKRMSVFAKVVELGSFTAAARQLQMSVSSISQTVAKLEDELQVKLLNRSTRSLGLTEAGKIYYQGCRRMLFEAQDVHEQLYAFNNTPIGTLRIGCSSTMAQNVLARITAKMLKEYPGLSVNLVTGIPAPDLIADGLDVVIRVGALQDSSLFSRRLGSMPMVLCAAKSYLAQAGNPEKPADLAGHAWLEYSVRPDNEFVIIAPEGISTRLTPQGRFVTNDPMTLVRWLTAGVGIAYVPLMWAIEEINRGELEILLPSYQSDPRPVYALYTEKDKLPLKVQVCINYLTEYFVDVAKIYQGMHGRGIAR

SEQ ID NO: 13675 - protein, 72 aa, Klebsiella pneumoniae
KFTRVTSTTTRHSNRKFLTSNRDYRQWLKINTTALVAAKVPQLAFSSNRATVKSLSTSVLWNSTSVVKLPAW

SEQ ID NO: 13676 - protein, 147 aa, Klebsiella pneumoniae
KTARRNWIILSLCVVLKSLPLLLRAREHGDLKENAEYHAAREQQGFCEGRIKDIEAKLSNAQVIDITKMPNNGRVIFGSTVSVLNLDTDEEQTYRIVGDDEADFKQNLISVNSPIARGLIGKEQDDVVTIRTPGGEVEYEITKVEYL

SEQ ID NO: 13677 - protein, 265 aa, Klebsiella pneumoniae
GVERLMLFNALAALGHRGIKTTATFGRAGLMLFNAVVGKPEFRKHAPLLVRQLYNVGVLSMLIIIVSGLFIGMVLGLQGYLVLTTYSAETSLGMLVALSLLRELGPVVAALLFAGRAGSALTAEIGLMRATEQLSSMEMMAVDPLRRVISPRFWAGVISLPLLTIIFVAVGIWGGALVGVSWKGIDGGFFWTAMQNAVDWRMDLVNCLIKSLVFAITVTWIALFNGYDAIPTSAGISRATTRTVVHASLAVLGLDFVLTALMFGN

SEQ ID NO: 13678 - protein, 231 aa, Klebsiella pneumoniae
SCRRRSRACCCFASAWRQWRSLSGSEVQKRRLGSWGALGSTINILVLDNPMQFQFSQFLDSALGQIVGCFLALMVILIVRDNSRARTGRVLLNQFVSAAVSSLTTNSARRKENHLPALYQQLFLLLNKFPGDVARFRLALTLIIAHQRLRDAPVPVNDDLSAFHRQLRRTADHVISAGSDDKRRRYFTQLLAELDVYQEKLRVWEASPQVTEPVRRLVEMLHKYQHVLTSS

SEQ ID NO: 13679 - protein, 198 aa, Klebsiella pneumoniae
PPPRPAPRWRPTASISSMKMMQGAAFLACSNMSRTREAPTPTNISTKSEPEMVKNGTFASPAIAFASSVLPVPGGPTIRTPFGILPPSFWKRLGSRRYSTSSPTSSFASSHPATSAKVVLIWSSVNIRALLLPKDIAPFPPPPCICRIKKIQTPISSSIGNQEMKMEASRLGSSGGSPTTLTFLVNRLSSSFGSLTGM

SEQ ID NO: 13680 - protein, 103 aa, Klebsiella pneumoniae
RADRTMFEQRVNSDVLTVSTVNSQDQVTQKPLRDSVKQALKNYFAQLNGQDVNDLYELVLAEVEQPLLDMVMQYTRGNQTRAALMMGINRGTLRKKLKKYGMN

SEQ ID NO: 13681 - protein, 143 aa, Klebsiella pneumoniae
ATVSSPPCCPSRVLWWRAALSRSTESLYPSRRQTSVNNWSDITDKEDTMQLNITGHNVEITPAMREFVTAKFSKLEQFFDRINQVYIVLKVEKVTQIADANLHVNGGEIHASAEGQDMYAAVDGLIDKLARQLTKHKDKLKQH

SEQ ID NO: 13682 - protein, 97 aa, Klebsiella pneumoniae
DVGLFSLSDKFEPMENHEIQTVLMNALPLQEVHVSGDGSHFQVIAVGEMFDGMSRVKKQQSVYAPLMEYIADNRIHALSIKAFTPQEWARDRKLNGF

SEQ ID NO: 13683 - protein, 376 aa, Klebsiella pneumoniae
IMQSLSPTSRYLLALKEGSHQPDDVQQEAVSRLDTIYQELQTQPAPVASGGGLRAKFGKLLGKREPAAGTAPVRGLYMWGGVGRGKTWLMDLFYQSLPGERKQRLHFHRFMLRVHEELTTLQGHSDPLEIVADRFKAETDVLCFDEFFVSDITDAMLLGGLMKALFARGITLVATSNIPPDELYRNGLQRARFLPAIDAIKQHCDIMNVDAGIDYRLRTLTQAHLWLSPLNNDTREQMDKLWLALAGAPRAAGPTLEINHRELPTLGVENQTLAASFATLCVDARSQHDYIALSRLFHTVMLFDVPVMTAQLESEARRFIALVDEFYERHVKLVVSAAVPLYDIYQGERLKFEFQRCLSRLQEMQSEEYLKRPHMP

SEQ ID NO: 13684 - protein, 157 aa, Klebsiella pneumoniae
LMRSSAKQEELVKAFKALLKEEKFSSQGEIVQALQEEGFENINQSKVSRMLTKFGAVRTRNAKMEMVYCLPAELGVPTTSSPLKNLVLDIDYNDAVVVIHTSPGAAQLIARLLDSLGKAEGILGSIAGDDTIFTTPARGFTVKDLHDAILVLFEQEL

SEQ ID NO: 13685 - protein, 672 aa, Klebsiella pneumoniae
ERSRVEPWATSFITKSLRLKRLKKKNPGADARGFKVKQASTAVAYLSPRCSDMVLPGFGVRGSSTGRGARGVPLLSEFVKRTRFFPTRWRTNFATSHQVVNLRRIDGLILHERIFHRVQNVHVVVQQLASTTVVTLNQRFHFLVDDTRGFIGHMLRFRDATAEEDFTLFFRIQQRTEFVGEAPLGHHVTRQVRRHFNIVGRTGRNMFRTVDNLFRQTTAVQGGDLAFQFLTAGADCIAFRQEEGHTQRTTARDNRHFVHRIVLRHQATNNRVARFMISSRLFLRFRHHHGATFRTHHDFVFRFLELNHRHNAFVTAGSKQRRFVDQVGQIRTGEARGTARNDCRIDIRRQRNATHMHFQDLLTTANIRQANHHLAVKTARTQQRGVKNVRTVSRRDNDDTFVTFEAVHLNQHLVQGLLTFIVTTAQACATLAADGVDFIDEDDARRGFLSLFEHVTHTRSAHTDEHFDEVRTGNGKERYLRFTSDRFRQQRFTGTRRADHQDAFRDFTAQFLEAARLTQVFYQLADFLFCFVTPGNVCKSGFDLVFRQHTGFAFAEGHRALPAAALHLPHKEDPDADQQQHWEPGDEDGSQQARLFWWFANNFDVFSQQVIEQLRIVNRNVSRVTVTIFLGNVDLTSVDTRFANLVLIDLLQEGRIIHLAAIRLAGPKALEY

SEQ ID NO: 13686 - protein, 397 aa, Klebsiella pneumoniae
FTESKMKFVDEATILVVAGDGGNGCVSFRREKYIPKGGPDGGDGADGGDVWLEADENLNTLIDYRFEKSFRAERGQNGQSRDCTGKRGKDVTVKVPVGTRVIDQGTGETMGDMTKHGQRLMVAKGGWHGLGNTRFKSSVNRTPRQKTMGTPGDKRDLQLELMLLADVGMLGMPNAGKSTFIRAVSAAKPKVADYPFTTLVPSLGVVRMDNEKSFVVADIPGLIEGAAEGAGLGIRFLKHLERCRVLLHLIDIDPIDGSDPVENARIIIGELEKYSEKLASKPRWLVFNKIDLMDKAEAEAKAKAIAEALGWEEKFYLISAASQQGVKELCWDVMTFIIENPIVQVEEEQKPEKVEFMWDDYHRQQLEEAEAEAEDDEDWDDDWDEDDEEGVEFIYKR

SEQ ID NO: 13687 - protein, 1493 aa, Klebsiella pneumoniae
SLGRFTDMLYDKSLERDNCGFGLIAHIEGEPSHKVVRTAIHALARMQHRGAILADGKTGDGCGLLLQKPDRFFRIVAEERGWRLAKNYAVGMLFLNKDPELAKAARRIVEEELQLETLSIVGWRDVPTNEGVLGEIALSSLPRIEQIFVNAPAGWRPRDMERRLFIARRRIEKRLQEDKDFYVCSLSNLVNIYKGLCMPADLPRFYLDLADLRLESAICLFHQRFSTNTVPRWPLAQPFRYLAHNGEINTITGNRQWARARTYKFQTPLIPDLHDAAPFVNETGSDSSSMDNMLELLLAGGMDIVRAMRLLVPPAWQNNPDMDPELRSFFDFNSMHMEPWDGPAGIVMSDGRYAACNLDRNGLRPARYVITKDKLITCASEVGIWDYQPDEVVEKGRVGPGELMVIDTRAGRILHSAETDDDLKSRHPYKEWMEKNVRRLVPFEDLPDEEVGSRQLDDDTLASYQKQFNYSAEELDSVLRVLGENGQEAVGSMGDDTPFAVLSSQPRIIYDYFRQQFAQVTNPPIDPLREAHVMSLATSIGREMNVFCEAEGQAHRLSFKSPILLYSDFKQLTTMEEEHYRADVLDITFNPAEASLSETVKALCDKAEQMVRDGTVLLVLSDRNIAKDRLPVPAPMAVGAIQTRLVDKSLRCDANIIVETASARDPHHFAVLLGFGATAIYPYLAYETLAKLVDSKAIDKPYRAVMLNYRNGINKGLYKIMSKMGISTIASYRCSKLFEAVGLHRDVSELCFQGVVSRIGGASFDDFQQDLLNLSKRAWLARKPLAQGGLLKYVHGGEYHAYNPDVVRTLQQAVQSGEYSDYQQYAKLVNERPAATLRDLLALNPGEDAISIDEVEPAKELFKRFDTAAMSIGALSPEAHESLAEAMNSIGGFSNSGEGGEDPARYGTNKVSRIKQVASGRFGVTPAYLVNADVIQIKVAQGAKPGEGGQLPGDKVTPYIAKLRYSVPGVTLISPPPHHDIYSIEDLAQLIFDLKQVNPKAMISVKLVSEPGVGTIATGVAKAYADLITIAGYDGGTGASPLSSVKYAGCPWELGLVETQQALVANGLRHKIRLQVDGGLKTGLDIIKAAILGAESFGFGTGPMVALGCKYLRICHLNNCATGVATQDDKLRKNHYHGLPFKVTNYFEFIARETRELMAQLGVKRLVDLIGRTDLLKELDGFTAKQQKLDLGKLLETAEPHPGKALYCTENNPPFDNGVLNAQLLQQAKPYVDEKQSKTFWFDIRNTDRSVGASLSGYIAQTHGDQGLAGDPIVAHFSGTAGQSFGVWNAGGVELHLTGDANDYVGKGMAGGLLAIRPPVGSAFRSHEASIIGNTCLYGATGGRLYAAGRAGERFAVRNSGAITVVEGIGDNGCEYMTGGIVCVLGKTGVNFGAGMTGGFAYVLDEDGDFRKRVNPELVEVLDVDSLAIHEEHLRGLITEHVQLTGSQRGEEILANWPAFSAKFALVKPKSSDVKALLGHRSRSAAELRVQAQ

SEQ ID NO: 13688 - protein, 111 aa, Klebsiella pneumoniae
CILGFVMRVTKQRPPTKRFDEVNIMKIKTTVAALSILSVVSFGAFAADIINSEQAQGREAIGTVSVGAVASSPMDMHEMLNKKAQEEGASSYRIIEARTGDHWHATAELYK

SEQ ID NO: 13689 - protein, 92 aa, Klebsiella pneumoniae
VRHGVRWDRRAIVARQILYNVPNFNLKSGADTQSRTGDLTLTKGALYQLSHISTLNLMPGSSLLSHGETPHYHRRYGVSLLSSAWGQVGPPR

SEQ ID NO: 13690 - protein, 252 aa, Klebsiella pneumoniae
EAGGPRAGAERMRLRVAPLALLKRLALRLLLIAAVFWGGGIALFSVLPVPFSAVMLERQVSAWLSGDFHYLAHSDWVAMDKISPWMGLAVIAAEDQKFPEHWGFDVSAIEKALAHNERHDTRIRGASTLSQQTAKNLFLWDGRSWLRKGLEAGLTVGIETVWSKKRILTVYLNIAEFGDGIFGVEAAAQRYFHKPASQLTPGEAALLAAVLPNPIRYRADAPSGYVRSRQAWILRQMRQLGGEGFMREHKLY

SEQ ID NO: 13691 - protein, 493 aa, Klebsiella pneumoniae
YQPGQLLPETGYAPARIWLIAMETYTIAPRHLRFAIKLACAVVLALFVGFHFQLETPRWAVLTAAIVAAGPAFAAGGEPYSGAIRYRGMLRIAGTFIGCIAALVIIILMIRAPLLMMLVCCLWAGFCTWVSSLVKVENSYAWGLAGYTALIIIITIHTNPMLAPQFAVERCSEIVIGIVSAIVADLLFSPRSIKKEIDLELDNLLIAQYKLMQLCVAHGEKEEVDQAWGALVRRTTALEGMRSNLIMESSRWAKANQRLKAINTLSLTLITQACETYLIQNSRPEMVTDDYRELFAEPVETVQDVHQQLKRMRRFLTWKGEHNTPVTIYSWVGAATRYLLLKRGVVGNTKISRIEDGVLRGETVVKVESAERHHAMVNFWRTSVSCILGTLFWLWTGWTSGSGAMVMIAVVTALAMRLPNPRMVAIDFLYGTLAALPLGTLYFLVIMPATQQSMLLLCISLAAMAFFIGIRSAKKASRIVGGAGEHHQHSGAG

SEQ ID NO: 13692 - protein, 903 aa, Klebsiella pneumoniae
TVAGRNSMTDVTIKALASEIQTSVDRLIQQFADAGIRKSADDSVTSQEKQTLLTHLNREHGSAPDKLTLQRKTRSTLNIPGTGGKSKSVQIEVRKKRTFVKRDPQEAERLAAEEQAQREAEEQARREAEEAAKREAQLKAEREAAEQAKREVADKAKREAAEKDKVSNQHTDEMTKTAQAEKIRRENEAAELKRKSEEEARRKLEEEARRVAEEARRMAEENEKNWSETSDSPEDSSDYHVTTSQHARQAEDDNDREVEGGRGRSRSSKAARPAKKGNKHAESKADREEARAAVRGGKGGKHRKGSALQQGFQKPAQAVNRDVVIGETITVGELANKMAVKGSQVIKAMMKLGAMATINQVIDQETAQLVAEEMGHKVILRRENELEEAVMSDRDTGAAAEPRAPVVTIMGHVDHGKTSLLDYIRSTKVASGEAGGITQHIGAYHVETDNGMITFLDTPGHAAFTSMRARGAQATDIVVLVVAADDGVMPQTIEAIQHAKAAQVPVVVAVNKIDKPEADPDRVKNELSQYGILPEEWGGESQFVHVSAKAGTGIDDLLDAILLQAEVLELKAVRNGMASGAVIESFLDKGRGPVATVLVREGTLHKGDIVLCGFEYGRVRAMRDELGREVLEAGPSIPVEILGLSGVPAAGDEVTVVRDEKKAREVALYRQGKFREVKLARQQKSKLENMFANMTEGEVHEVNIVLKADVQGSVEAISDSLLKLSTDEVKVKIIGSGVGGITETDATLAAASNAILVGFNVRADASARKVIEAESLDLRYYSVIYNLIDEVKAAMSGMLSPELKQQIIGLAEVRDVFKSPKFGAIAGCMVTEGTIKRHNPIRVLRDNVVIYEGELESLRRFKDDVNEVRNGMECGIGVKNYNDVRVGDMIEVFEIIEIQRSID

SEQ ID NO: 13693 - protein, 184 aa, Klebsiella pneumoniae
EPLMKFRTNKLSLKIALAGALLAASLPALAKTGDTDQPIHIESDQQSLDMQGNVVTFTGNVVVTQGTIKINADKVVVTRPGNEKGKEVIEGFGNPATFYQMQDNGKPVKGRASKMRYELQNDYVVLTGNAYLEQLDSNIKGDKITYLVKEQKMQAFSDKGRRVTTVLVPSELQDKSGNQQKKSN

SEQ ID NO: 13694 - protein, 474 aa, Klebsiella pneumoniae
HQVIQDIFPYTSGYESQHLMKKQTLLLSALALSIGLSLSVLPPAAASLPTQVPGQGALPSLAPMLEKVLPAVVSVQVEGTASPTLNMPEELKKYFGDNAPQEQAQPFEGLGSGVIIDAAKGYVLTNNHVINQAQKISVQLNDGREFDAKLVGSDEQSDIALLQLIKPDHLTQIAIADSDKLRVGDFAVAVGYPFGLGQTATSGIISALGRSGLNLEGLENFIQTDASINRGNSGGALLNLNGELIGINTAILAPGGGSIGIGFAIPSNMAKTLADQLIQFGEIKRGLLGIKGMEMSADIAKAMNLNVQRGAFVSEVLPNSGSAKAGIKSGDVIVSLNGKPLNSFAELRSRIATTEPGTKVKLGLLRDGKPVDVEVTLDKSTSSTASAELIIPALQGASFSDGQMKDGTKGVVIDNVDKGSAAAQVGLHKDDIIIGLNRQRIHSIAELRKALEGKPPVIALNVIRGNESIYLLLR

SEQ ID NO: 13695 - protein, 230 aa, Klebsiella pneumoniae
EYPILSAYREVGPCMARKTKEEAQRTRQLLIESAIQQFALRGVTNTTLTDIADAAGVTRGAVYWHFASKTELFNEMWQQQPPLRDLIQPSQAIEYEHEPLNALRERFIAGLRYIAANPRQRALMQILYQRCEFSSDMLSEYEIRQRIGFNYSLIGGILQCCVRNNILPAETNIEMILIVLHSAFSGLIKNWLLDPQRFDLYQQAPALVDNIMAVVCAARLSGGPALRLVN

SEQ ID NO: 13696 - protein, 382 aa, Klebsiella pneumoniae
GTAMTTHARVTLLSGLIISALLLTGCDNSDNQQPHAQAPQVTVHVVNSAPLSVTTELPGRTSAFRVAEVRPQVSGIILKRNFVEGSDVEAGQSLYQIDPATYQAAWNSAKGDEAKAEAAAAIAHLTVKRYVPLLGSKYISQQEYDQAVATARQADADVIATKAAVETARINLAYTKVTSPISGRIGKSSVTEGALVTNGQSDALATVQQLDPIYVDVTESSNDFMRLKQESLQRGGDTKSVELVMENGQAYPLKGSLQFSDVTVDESTGSITLRAIFPNPQHVLLPGMFVRARIDEGVDPQAILVPQQGVTRTPRGDASVMLVNDKNQVETREVVATQAVGDKWLITSGLKPGDKVIVSGLQKVRPGVTVKAEAERTAPAVQ

SEQ ID NO: 13697 - protein, 237 aa, Klebsiella pneumoniae
GADMSLLAQLDQRIRHHGGLIVSCQPVPGSPLDNPAIVAAMALAAEQAGAVALRIEGLANLQAVRPLVTVPVIGLIKRDLPDSPVRITPWLEDIDALAQGGADIIAIDGTQRQRPASVSALLAEIHQLGKVAMADCSSLDDALECWQLGAEIVGTTLSGYTAEETPDEPDLALVQCLSAAGCRVIAEGRYNTPAQAAEAMRCGAWAVTVGSAITRLEHICGWYNTALKAAVCPADEQ

SEQ ID NO: 13698 - protein, 322 aa, Klebsiella pneumoniae
LMRIGHHQLRNRLIAAPMAGITDRPFRTLCYEMGAGLTVSEMMSSNPQVWESDKSRLRMVHIDEPGIRTVQIAGSVPEEMAAAARINVESGAQIIDINMGCPAKKVNRKLAGSALLQYPDQVKSILTAVVNAVDVPVTLKIRTGWEPEHRNCVEIAQLAEECGIQALTIHGRTRACLFNGDAEYDSIRAVKQKVSIPIIANGDITDPLKARAVLDYTGADALMIGRAAQGRPWIFREIQHYLDTGELLPPLPLAEVKRLLCAHVRELHDFYGQAKGYRIARKHVSWYLQEHAPDDQFRRTFNAIEDASEQLEALEAYFENFA

SEQ ID NO: 13699 - protein, 187 aa, Klebsiella pneumoniae
RNLIMKSIAAKMVAVTIALGASSAACAAVNLHGEAGAEFTNLSASFGAGEPGMTFSSQWAHSDNDGDSVGLGMGYNFNLGPFLMTLGGKAVYLNPKDGDEGYAIAAGGGAELPLGQYFTLFGEGYYSPDSMSSGVEDYVEANAGVRLNVRPSLNIEAGYRYIDMAGKDGNRDNTLADGAYAGVNFRF

SEQ ID NO: 13700 - protein, 385 aa, Klebsiella pneumoniae
TALIFTAAGDFCALSLLRVVGKVSGFCFPPQLSGLSLSMLKKFRGMFSNDLSIDLGTANTLIYVKGQGIVLNEPSVVAIRQDRAGSPKSVAAVGHEAKQMLGRTPGNIAAIRPMKDGVIADFFVTEKMLQHFIKQVHSNSFMRPSPRVLVCVPVGATQVERRAIRESAQGAGAREVFLIEEPMAAAIGAGLPVSEATGSMVVDIGGGTTEVAVISLNGVVYSSSVRIGGDRFDEAVINYVRRNYGSLIGEATAERIKHEIGSAYPGDEVREIEVRGRNLAEGVPRGFTLNSNEILEALQEPLTGIVSAVMVALEQCPPELASDISERGMVLTGGGALLRNLDRLLMEETGIPVVVAEDPLTCVARGGGKALEMIDMHGGDLFSEE

SEQ ID NO: 13701 - protein, 136 aa, Klebsiella pneumoniae
SDTMNKIGLLIVAGVLGLAGCSSTSPSQTVETINALTVPVSPSESGTTANHAQAVRRYFQDNTALISRLNHSLKSHYLQDVERRDVFDRHSEAYKVYGALTRLEQMASMNEVYRKENNVAGLQEINRVLKSVPLTS

SEQ ID NO: 13702 - protein, 431 aa, Klebsiella pneumoniae
TPEIDYHSQQMALPASTQKVISALAALLQLGPDFRFTTTLETKGSLDGGVLKGDLIARFGGDPTLKRQDIRNMVATLKKAGVQRIEGNVLIDTSVFASHDKAPGWPWNDLTQCFSAPPAAAIVDRNCFSVSLYSAQKPGDVAFIRVASYYPVTMFSQVRTLARGSSEAQYCELDVVPGDLNRYTLTGCLPQRSEPLPLAFAIQDGASYAGAILKAELAQAGITYSGTLLRQTLANEPGTVLATSQSAPLHDLLRIMLKKSDNMIADTVFRTIGHARFGVPGTWRAGSDAVRQILRQQAGVDLGNTIIADGSGLSRHNLIAPATMMQVLQYIAQHDTELNFISMLPLAGHDGSLQYRAGLHQAGVDGKVSAKTGSLQGVYNLAGFITTASGQKMAFVQYLSGYAVEPADQRNRRIPLVRFESRLYKDLYQNN

SEQ ID NO: 13703 - protein, 189 aa, Klebsiella pneumoniae
CLGIEFMQTKKTEIWVGVFLLVALLAALFVCLKAANVTSLRTEPTYRLYATFDNIGGLKARSPVRIGGVVVGRVADITLDPKTYLPRVELDIDERYNHIPDTSSLAIRTSGLLGEQYLALNVGFEDPDLGTTILKDGGTIQDTKSAMVLEDLIGQFLYNSKGGDNQNSGNDKAEAEGHTDATPAAGTTH

SEQ ID NO: 13704 - protein, 221 aa, Klebsiella pneumoniae
PQLINSYLVIHIMNIKPPIRPQKTIDRLIDVLEPHATPVNAIARKRLTWEYKGKTQLFIFKKGELSIIRNSDRLLMVTVYEPHLFGVAEMLQPSRSHSLRAEVSCELLRIDYDLASALFRQHNLWEEVTSLLAYHTSYMVYRDDLVLQQRTYSVIRNHLLEMMLLSEETRQRVSILEYIQDRTLLSRSSILNVLSALKKGGYITFARGGYLQNIVSLPEKF

SEQ ID NO: 13705 - protein, 60 aa, Klebsiella pneumoniae; identical to SEQ ID NO: 8602

SEQ ID NO: 13706 - protein, 113 aa, Klebsiella pneumoniae
LNVFRNARTRSPGKRKTGGGVGQLCSMGPRGVARFGLSLVRAMQGEKGVVECAYVEGDGHYARFFSQPLLLGKNGVEERQSIGKLSAFEQQALEGMLDTLKKDIALGEDFVNK

SEQ ID NO: 13707 - protein, 498 aa, Klebsiella pneumoniae
KAPMNKEILAVVEAVSNEKALPREKIFEALESALATATKKKYEQEIDVRVEIDRKSGDFDTFRRWLVVEEVTQPTREITLEAARFEDESMNVGDYVEDQIESVTFDRITTQTAKQVIVQKVREAERAMVVDQFREHEGEIITGVVKKVNRDNITLDLGNNAEAVILREDMLPRENFRPGDRIRGVLYAVRPEARGAQLFVTRSKPEMLIELFRIEVPEIGEEVLEIKAAARDPGSRAKIAVKTNDKRIDPVGACVGMRGARVQAVSTELGGERIDIVLWDDNPAQFVINAMAPADVASIVVDEDKHTMDIAVEAGNLAQAIGRNGQNVRLASQLSGWELNVMTVDDLQAKHQAEAHAAIDTFTKYLDIDEDFATVLVEEGFSSLEELAYVPMKELLEIDGLDEATVEALRERAKNALTTLALAQEESLGDNKPADDLLNLEGLDRALAFKLAARGVCTLEDLAEQGVDDLADIEGMTDEKAGELIMAARNICWFGDEA

SEQ ID NO: 13708 - protein, 484 aa, Klebsiella pneumoniae
IFTMSYVDWPPLILRHTYYMAEFETTFADLGLKAPILEALTDLGYEKPSPIQAECIPHLLDGRDVLGMAQTGSGKTAAFSLPLLNNIDPELRAPQILVLAPTRELAVQVAEAMTEFSKHMRGVNVVALYGGQRYDVQLRALRQGPQIVVGTPGRLLDHLKRGTLDLSKLSGLVLDEADEMLRMGFIEDVETIMAQIPEGHQTALFSATMPEAIRRITRRFMKEPQEVRIQSSVTTRPDISQSYWTAYGMRKNEALVRFLEAEDFDAAIIFVRTKNATLEVAEALERNGYNSAALNGDMNQALREQTLERLKDGRLDILIATDVAARGLDVERISLVVNYDIPMDSESYVHRIGRTGRAGRAGRALLFVENRERRLLRNIERTMKLTIPEVELPNAELLSKRRLEKFAAKVQQQLESSDLDQYRALLAKIQPTAEGEELDVETLAAALLKMAQGERSLIVPPDAPMRPRREFRDRDDRFDRSWRP

SEQ ID NO: 13709 - protein, 493 aa, Klebsiella pneumoniae
FSAIFLWRTMMQFEVIIPLIAYLVVVFGLSLYAMRKRASGSFLNEYFLGSRSMGGFVLAMTLTATYISASSFIGGPGAAYKYGLGWVLLAMIQLPAIWLSLGVLGKKFAILARRYNAVTLNDMLFARYQSRLLVWLASLSLLVAFVGAMTVQFIGGARLLETAAGIPYDTGLLIFGVSIALYTAYGGFRASVLNDTMQGMVMLIGTIVLLVGVIHAAGGVGHAVETLQSIDVKLVSPQGAEDILSPTFMASFWVLVCFGVIGLPHTAVRCISYKDSKAVHRGIIIGTIVVAILMFGMHLAGALGRAVIPDLTVPDLVIPTLMVKVLPPFAAGIFLAAPMAAIMSTINAQLLQSSATIIKDLYLNWRPDQATNEKRLKRMSAGITLLLGVLLLLAAWRPPEMIIWLNLLAFGGLEAVFLWPLVLGLYWERANAAGALSAMIVGGVLYAVLATLKVQFLGFHPIVPALLLSLLAFVAGNRFGRPAPQSPILTTDK

SEQ ID NO: 13710 - protein, 475 aa, Klebsiella pneumoniae
GVKMSQNVYQFIDLQRVDPPKKPLKIRKIEFVEIYEPFSEGQAKAQADRCLSCGNPYCEWKCPVHNYIPNWLKLANEGRIFEAAELSHQTNTLPEVCGRVCPQDRLCEGSCTLNDEFGAVTIGNIERYINDKAFEMGWRPDLSDVKPTGKTVAIIGAGPAGLACADVLTRNGVKAVVFDRHPEIGGLLTFGIPAFKLEKEVMTRRREIFTGMGIEFKLNTEVGRDVQLDDLLKEYDAVFLGVGTYQSMRGGLDNEDAPGVYDALPFLIANTKQIMGFGETADEPYVSMEGKRVVVLGGGDTAMDCVRTSVRQNAAHVICAYRRDEENMPGSKREVKNAREEGVEFQFNVQPLGVEVNANGKVCGVKMARTEMGQPDAKGRRRAEIVPGSEHVVPADAVVMAFGFRPHSMEWLAKHSVELDSQGRIIAPEGSENAFQTSNPKIFAGGDIVRGSDLVVTAIAEGRKAADGILNYLEV

SEQ ID NO: 13711 - protein, 494 aa, Klebsiella pneumoniae
RKGIKMTAELLVNVTPSETRVAYIDGGILQEIHIEREARRGIVGNIYKGRVSRVLPGMQAAFVDIGLDKAAFLHASDIMPHTECVAGEEQKQFTVRDISELVRQGQDLMVQVVKDPLGTKGARLTTDITLPSRYLVFMPGASHVGVSQRIESEAERERLKKVVAEYCDEQGGFIIRTAAEGVHEQEMAADAAYLKRVWTKVMERKKRNQTRYQLYGELALAQRVLRDFADAQLDRIRVDSRLTYEALLEFTAEYIPEMTSKLEHYSGRQPIFDLFDVENEIQRALERKVELKSGGYLIIDQTEAMTTIDINTGAFVGHRNLDDTIFNTNIEATQAIARQLRLRNLGGIIIIDFIDMNNEDHRRRVLHSLEQALSKDRVKTSINGFSQLGLVEMTRKRTRESVEHVLCNECPTCHGRGTVKSVETVCYEIMREIVRVHHAYDSDRFLVYASPAVAETLKGEESHALAEVEIFVGKQVKVQIEPLYNQEQFDVVMM

SEQ ID NO: 13712 - protein, 313 aa, Klebsiella pneumoniae
ATAVDACLTLKPRASAPGFFFFNLFSLRDFVMKLVAQGSTLDLSHPHVMGILNVTPDSFSDGGAHNSLIEAVKHANLMINAGATIIDIGGESTRPGAAEVSVEEELARVIPVVEAIAQRFEVWISVDTSKAEVIRQSARAGAHIINDIRSLTEPGALQAAAETGLPVCLMHMQGQPKTMQEAPKYEDVFADVERFFNEHIVRCEQAGIAKEKLLLDPGFGFGKNLSHNYQLLARLGEFHHFGLPLLVGMSRKSMVGQLLNVGPSERLNGSLACAVIAAMQGAQIIRVHDVKETVEALRVVEATLAAKGKKRYE

SEQ ID NO: 13713 - protein, 156 aa, Klebsiella pneumoniae; identical to SEQ ID NO: 8616

SEQ ID NO: 13714 - protein, 165 aa, Klebsiella pneumoniae
IMDVSQLTPRRPYLLRAFYDWLLDNQLTPHLVVDVTLPGVLVPMEYARDGQIVLNIAPRAVGNLELANDEVRFNARFGGVPRNVSVPLAAVLAIYARENGAGTMFEPEAAYDEDVSSLNDDDVAPESESETVMSVIDGDKPDNHDDDPDDTPPPRGGRPALRVVK

SEQ ID NO: 13715 - protein, 91 aa, Klebsiella pneumoniae
IMTVKQTVEITNKLGMHARPAMKLFELMQNFDAEVLLRNDEGTEAEANSVIALLMLDSAKGRQIEVEASGPQEVEALAAVIALFNAGFDED

SEQ ID NO: 13716 - protein, 352 aa, Klebsiella pneumoniae
VFRVPVTDESPATRCGAFYIRLPENFCRETGMKQQAGIGIILALTTAMCWGALPIAMKQVLEVMAPPTVVFYRLLMASIGLGAILAIKGKLPPMRIFRKPRWLVLLAIAAGGLFGNFILFSSYLQYLSPTASQVIGQLSPVGMMVASVVILKERMRGTQVVGALMLLSGLVMFFNTSLIEIFTRLTDYTWGVIFGVAAATVWVSYGVAQKVLLRRLASQQILFLLYTLCTIALLPLAEPGVISRLSSWQLACLIFCGLNTLVGYGALAEAMARWQAAQVSALITLTPLFTLLFSDLLSMAWPDVFARPMLNLIGYLGAFVVVAGAMYSAIGHRLWGRWRKREAVVPLPRSGE

SEQ ID NO: 13717 - protein, 233 aa, Klebsiella pneumoniae
STFLTGFSELHGGAKAMKKIGVVLGGCGVYDGSEIHEAVITLLAIARNGAQAVCFAPDKPQRDVINHLTGEAMPEQRNVLVEAARIARGDILPLVQARAETLDALIVPGGFGAAKNLSSFAAEGSECQVDPDLRALALAMHQTGKPLGFMCIAPAMLPKIFAFPLRITIGTDLDTADVVEEMGAEHVPCPVDDIVVDEDNKVVTTPAYMLAEDIAQAATGIEKLVARVLALSA

SEQ ID NO: 13718 - protein, 300 aa, Klebsiella pneumoniae
PVQVRFCKNVVIVAQERAMLARQVFSKDDFMSQTQANLVEVRGIRFSRGDRVIFDDISLSVPRGKITAIMGPSGIGKTTLLRLIGGQIPPDRGEILFDGENVPQMTRSRLYTVRKRMSMLFQSGALFTDLNVFDNVAYPLREHTHLPPALLHTTVMMKLEAVGLRGAAKLMPSELSGGMARRAALARAIALEPDLIMFDEPFVGQDPITMGVLVKLISELNSTLGVTCIVVSHDVPEVLSIADYAYIVADKKIVAHGSAQSLRENTDPRVRQFIDGIADGPVPFRYPAGDYHHDLLGIGS

SEQ ID NO: 13719 - protein, 1020 aa, Klebsiella pneumoniae
TAQVLFMDGQRINVQHFHQLRVHAFAEVAIFIQDIGKAAGHPCAKVDAGFSEHADDAAGHIFAAVVADAFHHGDGAGVTHGETLARAACGVQTTTGRAVQAGVADNAGFMAAERRAHRRTNGQQTARHAFPDVVVGVASQMQFHAAGVPHAEALARGAAKVSDDRVARQSLVAMGLGDIPGQRGPHGAVGVTDIKPERLALLFIHVRFRLLQQLGVEHAVIERWVVLGAVQRFARMRLCGLQQFTQIQFLLLGGEPIQLFEQIGAANQIHQTLDAQLGHQLAGLTGDKFKVVGHFERQTVIVILTQFVILGRHAGSAVVQVANTQVFTAQRDHRAGTETEALRAEDRRFDDIKTGFQAAIHLQTDLMTQTVGNQRLLGFHQAELPRTAGIFHRRERARPGAAVVAGDGDQVGIGFGHAGGDGANARLRNQFDRNHRFRIDLLEVENQLRQILDRVDIVVRRRGNQRDARYRIAQFGDVRGDFITRQLATFTRFRPLGDFDLDDVGIDQVGWRDAEAAGSDLLDARHFISAVARRVFTAFTGVGEAADAVHRFRQRLVRFRAQGADRHRRGIEAFKQLLRRLYFVDADGVFAWVERQQVAQRGRWTFVNQFRVLLIIAVFAALHGLLQGAHHVRVVGMIFAAVHIFQQTALGQWLTRQPGAFRQIQQILLEVVEAGAADAADHALEAELGDIAMQTDRFEQLRAAVGGDGRDPHLGHDLIQTFIDTVAIVQHHRTVRFIDGFAVDQLRQRFVGEVWIDSRRPKAEQHGEVVRIAGAGGFNDDVGIAAQAFIDQTGLDRANGHRRRYRQTVFGDVAVREHQQHGAVAHHLLRFIAQRFHRLAEGGLCRVERDIEDVGAIVLFFHRRQLFKIGVQQDRRFEAQTMRLAFRFAEDVHFAADAGSQRHDVRFAQRVDRRVSHLGELLTEVIVDNARLAGEHGERRVIAHRTDCFLAIFAEHAQDGVQLFRAVVKLFLVAGERVVIQLATANLFVRQIFERHQATNVFLHPLFIRVAALQIVIGFR

SEQ ID NO: 13720 - protein, 360 aa, Klebsiella pneumoniae
VEQVKTMQMTMRWFGPEEDKISLEHIRQVPGVEGVVGALYDVAVGEVWPVDKIERLVGQAHAAGLKMEVIESVNIHDDIKIGLPTRDRYIANYQQTIRNLARFGVKVICYNFMPVFDWMKTDMNYVLPDGSLTMAFEKKDIDKRLEDVVKEVLENSNGFALPGWEPERLAEVQTLFAKYSAVDDQKLRENLVYFLQAVIPVCEEVGVKMAIHPDDPPYSIFGLPRVVKNRDDLDWICRAVDSPANGITLCTGSIAEDPDNDVYAILAEFTRRKRIHFAHVRNIKLMQDKDFYECAHPSEYGSLDMYKVMQALYDNGFDGYIRPDHGRFIWGETGRPGYGLFDRALGVTYLKGLWEALSKR

SEQ ID NO: 13721 - protein, 463 aa, Klebsiella pneumoniae
GCWVELTTVYRAGFYFMTTILKHLPVGQRIGIAFSGGLDTSAALLWMRKKGAVPYAYTANLGQPDEDDYDAIPRRAKEYGAEGARLIDCRKQLVAEGIAAIQCGAFHNTTGGLTYFNTTPLGRAVTGTMLVAAMKEDGVNIWGDGSTYKGNDIERFYRYGLLTNAELQIYKPWLDSDFINELGGRHEMSEFMIACGFDYKMSVEKAYSTDSNMLGATHEAKDLEFLNSSVKIVNPIMGVKFWDENVKIPAEEVTVRFEQGHPVALNGKTFADDVEMMLEANRIGGRHGLGMSDQIENRIIEAKSRGIYEAPGMALLHIAYERLLTGIHNEDTIEQYHAHGRQLGRLLYQGRWFDSQALMLRDSLQRWVASQITGEVTLELRRGNDYSILNTVSDNLTYKAERLTMEKGDSMFTAEDRIGQLTMRNLDITDTREKLFGYAQSGLLSASSATGLPQVENLENKGK

SEQ ID NO: 13722 - protein, 484 aa, Klebsiella pneumoniae
PEIFTLNMKQGLQLRLSQQLAMTPQLQQAIRLLQLSTLELQQELQQALESNPLLEQTDLHDEVEAKEVEDRESLDTVDALEQKEMPDELPLDASWDEIYTAGTPSGNGVDYQDDELPVYQGETTQTLQDYLMWQVELTPFTDTDRAIATSIVDAVDDTGYLTIQIEDIVDSIGDDEIGLEEVEAVLKRIQRFDPVGVAAKDLRDCLLIQLSQFAKETPWLEEARLIISDHLDLLANHDFRTLMRVTRLKEEVLKEAVNLIQSLDPRPGQSIQTSEPEYVIPDVLVRKVSGRWTVELNADSIPRLKINQQYAAMGNSARNDADGQFIRSNLQEARWLIKSLESRNDTLLRVSRCIVEQQQAFFEQGEEYMKPMVLADIAQAVEMHESTISRVTTQKYLHSPRGIFELKYFFSSHVNTEGGGEASSTAIRALVKKLIAAENPAKPLSDSKLTSMLSEQGIMVARRTVAKYRESLSIPPSNQRKQLV

SEQ ID NO: 13723 - protein, 297 aa, Klebsiella pneumoniae
PSVFPPVRRQQTSSITMSLNLVSEQLLSANGLNHQDLFAILGQLTERRLDYGDLYFQSSYHESWVLEDSIIKDGSYNIDQGVGVRAVSGEKTGFAYADQISKLALEQSAQAARTIVRDTGNGKVQTLGAVEHRALYTSIDPLQSMTREEKLDILRRVDKVARAADQRVQEVSASLSGVYELILVAATDGTLAADVRPLVRLSVSVLVEEDGKRERGSSGGGGRFGYDYFLASQEGDVRADAWAKEAVRMALVNLSAVAAPAGMLPVVLGAGWPGVLLHESGRPWAGRRFQPAWHLGL

SEQ ID NO: 13724 - protein, 70 aa, Klebsiella pneumoniae; identical to SEQ ID NO: 9056

SEQ ID NO: 13725 - protein, 148 aa, Klebsiella pneumoniae
IHRLALSSPVVKTNCETGAAWLSSARVVKCWVKSRNERNPYPLLPAVRPGTQRRLPVINWRKVGMTSSHHGPYDQGYTRATMAYTKRSDLARASGPHKVCRSPDWSLQLDSMKSESLVIVDQNATVNTFPGLVHTARHTMGVGCKRSR

SEQ ID NO: 13726 - protein, 66 aa, Klebsiella pneumoniae; identical to SEQ ID NO: 11781

SEQ ID NO: 13727 - protein, 79 aa, Klebsiella pneumoniae
TLQFNPQLRIGIPCRSPYTVNFATEYQSRPHYTKGTQSHPKVLPLLVRTRFQVLFHSPRRGSFRLSLTVLVHYRSVRSI

SEQ ID NO: 13728 - protein, 147 aa, Klebsiella pneumoniae
PSGSVYYSSFVGHSRQNSVGQRPLSRRMVQRFVSFTNLLMLKTTLLFFATALCEIVGCYLPWLWLKRGATPLLLIPTALALALFVWLLTLHPAASGRVYAAYGGVYVCTALLWLRVVDGVKLTHYDWAGAAVALCGMLIIVAGWGRA

SEQ ID NO: 13729 - protein, 633 aa, Klebsiella pneumoniae
ACSSFSVPGYRSRTGRESRRSGDKRLAGPMAGTYWPERGGGTRPVVGTQPLARSPAADLVTGGGEMSPPQQRGLALWASLLSALVCLLFLPVPRWGAWVILLVTLALIIGIWRIASRRTGRNVASTLAPLPEGAYRQPVIFVCGDLPCVWPQASPVRVVKQGCWIRVEKTEELQQVARQVLSQRPEWGPQLSVLLCVCPQRHAQSDALTSALLALRWQLSQLRQQTGYAVPLALQGQVGSAMSRDLLWQAAIPGEAVKVWQPSCAPCFVPAWVRAGGAAALEQQVLMNSLMGWSEQHVHAVLTEENTDLPPLTPAAVLWGLGPSLPGSLASSAWTTWLSRHSGLTRVAGWQPDESDTGDASALPEFILPQLPAGRGLTPRGRAWRAALAIFTLAAVAALLSSGWNNRQLLQRVGVDIARYERIAMDDYRPKASAVRVLREDAALLDSWARNGVPLRLSLGLYHGEQIRLPLLEAIRGYVPPPPPPGPVQHVAPDVIRLDSMSLFDTGKWVLKPGSTKRLVSSLMDIKARPGWLIVVAGHTDSVGEEKANQLLSLKRAESVRDWMRDTGDVPDSCFAVQGYGESRPIATNDTPEGRALNRRVEISLVPQVDACRLPDQPSASSQDDGASLHNGE

SEQ ID NO: 13730 - protein, 565 aa, Klebsiella pneumoniae
YAASYDRVLRDNSIMPAMKKTIISLTALAMLVSAATHAEADTSKKTDFLLIGGGIMSASLGTWLQALQPDWDLTMVEKLDGVALESSNGWNNAGTGHSANMELNYTPERADGSIDVSKALDINEQFMISRQFWSAQVKRGILHDPHSFINSTPHMSFVWGDNVDYLQKRYNALQQTTLFQGMKFSTDHAQIKQWAPLVMEGRDPQQKVAATWTPVGTDVNYGEITRQLIGSLKKNNHFTLQTSSEVTDFKRNADNSWHVTIKNVQSGEAQTIDAKYVFIGAGGGALKLLQKTGIPEADNYAGFPVGGSFLMTENPAVTAQHLEKVYGQASVGAPPMSVPHLDARYLDGKRVVLFGPFATFSTKFLKNGSFFDLLSTTTTNNVLPMTHVGLDNFDLVKYLVSQVMLSDDDRFAALKEYYPDARKEDWKLIQAGQRVQIIKKDAEKGGVLKLGTEVVVDQQKTISALLGASPGASTAAPITLNVLKQMFPQQFNSPEWQSRIHAIVPSYGQKLNGNVALTQQVWDDTAATLQLTKPPVIQMPAAAPTATAKPAETPREASPQHDMAL

SEQ ID NO: 13731 - protein, 141 aa, Klebsiella pneumoniae
TLSSKLPEAPPIFTATSLPITWQQTMVRASHWVGLTLPGIIDDPGSFSGMAISPMPQRGPEASQRTSLAIFISEAARPFSAPWAWTRASTVASASNLFGAVTNGCPLSDASSAATRTAYSGWVFSPVPTAVPPSASSARCG

SEQ ID NO: 13732 - protein, 355 aa, Klebsiella pneumoniae
NDLSKGKGVSQQVMAIAKKITINDVALAAGVSVSTVSLVLSGKGRISSATGERVNQAIEQLGFVRNRQAASLRGGQSGVIGLIVSDLSKPFYAELTAGLTDALERQGKMVFLTQGGRSGEKMAQRFDTLAAQGVDGVIIAGAIDRGSELRERAAEAGVPLVFASRASYLDDVDLIRPDNMQAAQLVTEHLIRRGHQRIAWLGGQSASLTRAERVGGYCATLLKYGLPFHSEWVLECESSQKQAAEAMTGLLRQNPTITAVLCYNNVVATGAWFGLLRAGRQSGEDGVESYFEQRVALAAFADVPEAALDDLPLTWVTTPAREMGKSLADSMLRRLEEGTGETRNQIMPPRLVTRK

SEQ ID NO: 13733 - protein, 384 aa, Klebsiella pneumoniae
LPVSRCNALPAANNYHHFISGVVMSQQDAAKQQANTRNNIRVVSIFTAAAIGLVGVLVILYAWQLPPFTRHSQFTDNAYVRGQTTFISPQVNGYITAVNVKDFAIAQPGEVLFQIDDRIYKQRVHQAQATLAMKEAALRNNLQQRKSAEATIAKNEAALQNARAQNLKIQADLKRIQQLTADGSLSIRERDSARASAAQGAADIEQAKAALEMSRQDRESTIVNRDSLEADVASAKAALELAQIDLQNTQIIAPTGGQLGQISVRLGAYVSAGTHLTSLVPPQHWVIANLKETQLAEVRVGQPVTFTVDALNGETFHGKVQSISPATGVEFSAISPDNATGNFVKIAQRIPVRITVNDGQNNSERLRPGMSVQVTIDTRAEKQP

SEQ ID NO: 13734 - protein, 482 aa, Klebsiella pneumoniae
IVASGAEICEDTRLQIVCLLIREYIVTAFSTLTVLPAAQLANLNELGYLSMTPVQAAALPAILAGKDVRVQAKTGSGKTAAFGLGLLQHIDPARFETQSLVLCPTRELADQVAGELRRLARCLPNIKILMLCGGQPFGAQRDSLQHAPHIIVATPGRLLDHLQKGTVSLDALQTLVMDEADRMLDMGFSDAIDEVIRFAPADRQTLLFSATWPAAIAAISGRVQLNPQTIEIDTVDALPAIEQQFFEISRHGKIALLQRLLSQHQPASCVVFCNTKRDCQAVCDALNAAGQSALSLHGDLEQRDRDQTLVRFANGSVRVLVATDVAARGLDIKSLALVVNFELAWDPEVHVHRIGRTARAGEQGLAISFCAPEEAQRATILADMLQLSLNWLPAPTGNTIAPLTAEMATLCIDGGKKAKMRPGDVLGALTGDMGFDGADIGKITVHPAHVYVAIRQNMAQKAYKQLQNGKIKGKSCRVRLLK

SEQ ID NO: 13735 - protein, 552 aa, Klebsiella pneumoniae
VTMSTKPFVYQDPFPLAHDDTEYYLLSKEHVSVAEFDGQQVLKVEPQALTLLAQQAFHDAAFMLRVSHQQQVGSILLDPEASDNDKYVALQFLRNSEIAAKGVLPTCQDTGTAIIMGKKGQRVWTGGGDEAALAQGVYNTYTEDNLRYSQNAPLDMYKEVNTGTNLPAQIDLYSVDGEEYKFLCMAKGGGSANKTYLYQETKALITPAKLKNYLVEKMRTLGTAACPPYHIAFVIGGTSAEATLKTVKLASTRYYDGLPTEGNEHGQAFRDVQLEQELLQEAQNLGLGAQFGGKYFAHDIRVIRLPRHGASCPIGMGVSCSADRNIKAKINRDGIWIEKLESNPGKYIPEHLRQAGEGEVVSINLNQPMSEILAQLSAHPVSTRLSLNGTIIVARDIAHAKLKELIDNGEALPQYVKDHPIYYAGPAKTPAGYASGSLGPTTAGRMDSYVDLLQSHGASMVMLAKGNRSQQVTDACHKHGGFYLGSIGGPAAVLAQQSIKSLECVAYPELGMEAIWKIEVEDFPAFILVDDKGNDFFQQIQNKQCAGCKQHG

SEQ ID NO: 13736 - protein, 448 aa, Klebsiella pneumoniae
GHMSGFEANFDGLVGPTHHYAGLSVGNEASQNNRDGLSNPKKAALQGLYKMKALADRGFVQGILPPQPRPNLRLLREVGFQGSDEQVIRQAAHAAPQLLSAFSSASSMWTANAATVSPSADSADGKVHFTVANLNNKLHRMQEAPTTSAILGATFADPRYFAHHAALPQHGDLGDEGAANHNRFCREYGRQGVQFFVYGRRASGGIAPVKYPARQTLEASEAVARLHQLDPRYTVFAQQAPQAIDRGVFHNDVIAVSNRHVLFHHQQAFVDQATVLATLRAKSDSLDIPFTSVEVPDERVSLDDAVASYLFNSQLLSKPDGKMLIVVPEECRQRENVWRYLSDLAADSASPIDEVAVFDLRESMRNGGGPACLRLRVVLNEAERKAVNAHSLMNDERYQQLTAWVEKHYRDRLHARDLADPQLLREVYQALDELTQILRLGAVYDFQR

SEQ ID NO: 13737 - protein, 122 aa, Klebsiella pneumoniae
RFPSGSVHGPGRRSRYRKPTRRRRSARRISPPARRHRSAALQLPPRRPAPDAGPPPVRGELPASPRRAAPRSALPAVCRRIRSAGASRAGDAGRRSSGSRARIRRYPQTASWPTPGRGRWRR

SEQ ID NO: 13738 - protein, 429 aa, Klebsiella pneumoniae
RSPSKCFTIAESLFRSAKIRESMVVADSQPGHIDQIKQTNAGAVYRLIDQLGPVSRIDLSRFAQLAPASITKIVREMLEAHLVQETEIQEPGSRGRPAVGLMVETEAWHYLAVRISRGEIHLSLRDLSSQLVVEDQLELALTDSTPFLTRVIDHIDRFFIRHQKKLERLTSIAMTMPGIIDTENGIIHRMPFYEDVKDVPLGEALANHTGVPVYIQHDISAWTMAESLFGASRGARDVIQVVIDHNVGAGVITDGRLLHAGSSSLVEIGHTQVDPYGKRCYCGNHGCLETIASVESVLELAQMRMAQSMSSLLHQRPLSVEWLCQAALQGDLLARDIISGVGNHVGRILAIMVNLFNPQKILIGSPFNLAAEILFPAISSCIRQQSLPAYSRHITVESTQFSNRGTMAGAALVKDALYNGSLLIRLLQG

SEQ ID NO: 13739 - protein, 253 aa, Klebsiella pneumoniae
FAESMAMHKLARQKHILDRLSETGQLSISELVAELQVSADTIRRDLSDLEQQGVLQKSHGGAIALNVPAMTRQGRNALLTQTKQRLGQQVAARIPSGSTLFLDAGSTLLAVAAQLKGPLTVITASLDIAQLFSDRADIQLILLGGQWDSKQRLFAGSATLSLVTRYRADIAILGACALHAGLGLSASQEADADVKRAMLAASAEHWLVADHTKLNRCEPWRVAGLSDIHHLFLDRPWAELGDDPALSVHIADA

SEQ ID NO: 13740 - protein, 435 aa, Klebsiella pneumoniae
AEWSQHSVGKQQLLRKEFSVSRTTTVDTVPAGEVSVAGASRPDPFIKRGTPQFMRVTLALFSAGLATFALLYCVQPILPVLSNEFGVSPASSSISLSISTAMLAVGLLFTGPLSDAIGRKPVMVTALLLAACCSLLSTMMTSWHGILIMRALIGLSLSGVSAVGMTYLSEEIHPSFVAFSMGLYISGNSIGGMSGRLLTGVFTDFFGWRVALAAISGFALAAAIMFWRILPESRHFRPTSLRPKTLLINFRLHWRDRGLPLLFVEGFLLMGAFVTLFNYIGYRLMMSPWSLSQAVVGLLSVAYLTGTWSSPKAGAMTVRFGRGPVMLGFTAVMLCGLLLTLFSSLWLIFIGMLLFSAGFFAAHSVASSWIGPRARRARGQASSLYLFSYYLGSSLAGTLGGVFWHHYGWNGVGGFIALLLLAALLTGTCLHQRLK

SEQ ID NO: 13741 - protein, 143 aa, Klebsiella pneumoniae
SLRSFFHLTERHIAMKKTRYTEEQIAFALKQAETGTRVEEVCRKMGISEAIFYNWKKKFGGMGVTKLRRLRQLEEENQRLKRLVADLSLDKVMLQEVIKKSSEAGSEASGGAFSAGGLPYQCPTGMRTADAEQNRLPLAEPAG

SEQ ID NO: 13742 - protein, 545 aa, Klebsiella pneumoniae
SFRSRLLLVITQPGGLSAWLHLWINAMKKSLVAAGVIVALGVVWTGGAWFTGKQLEGRIADMVQQANAQLRSSAPESGLELSYQDYQRGLFSSHLQLVVKPIAGQANGWLAAGQSVVLDEVVDHGPFPLASLKAFNLAPAMASVHTTLVKNDASQALFEIAKGDTPFTVDTRIAYSGDSQSAIVLNALDYAKGDEKVTFSGGQFQLDADRDGKNISLKGQAGSGQIDALNEYNQKVQLRFVNLTTDGATELASFNERIGQQKMTLDKLAISVEGKELALIDGMALDGGSTLTQDGKGVNSQVNYTVNSLKLQGQDMGSGKLTLKVDNVDGQAWHQFSQQYSAQSQALLAKPELAQNPELYQQALTETLFNALPILLKGNPSVTISPLSWRNAKGESTLNLSVLLKDPAQVTAPPQTLADSLDRVVQSLDGKVVIPVDMATEFMTKIAGLEGYQPADAAKLADQQVKGLAAMGQMFRITTMEDNAISSSLQYANGQVTLNGQKMPLQDFAAMFGLEAPSLPDSAPQEGQPQQDDAAPQQDDAAPQP

SEQ ID NO: 13743 - protein, 207 aa, Klebsiella pneumoniae
PLLPRAPDHSLPVIIRAGLPGASCRSRLVHSVTRRYQTLTESSKRQAYSDFTGPAVGLKLRKLFEDIRMKKVLALVVAAAMGLSSAAFAADAVSTTQAPAATHSTAAKTTHHKKHHKAAAKPAAEQKAQAAKKHKKAEAKPAAAQKAQAAKKHKKVAAKPAAPQKAQAAKKHHKAAAKPAAQKAQAAKKHHKTTKHQAAKPTAQPAA

SEQ ID NO: 13744 - protein, 154 aa, Klebsiella pneumoniae
KRTFSAKGVRAMYKKILLPVDVFEMDLSDKAVRHAEFLASAENGEITLLNVLPNSSRSLLRGFTADIRKFEAYMKEESEKKMREVARLFAIPMTRIHTRVVFGNVRDEILAISNNEEFDVIVIGSRKPGISTHLLGSNAESILRYAKTPVLVVR

SEQ ID NO: 13745 - protein, 198 aa, Klebsiella pneumoniae
NSPPAGSERSEILGCNHAVDGRFRVRLRFGRDFRAVSDTFGEHKVHVGDADEAEEGGQVRGDQVGRSIFMDTAAAGNDDRAFTGYQTFRPFLGVAEGDAGASHQVEIVFQLRRDVEVVHRRSDNNHIVAFQFGDQLVGKGQRFLLTRSQRRVARTQGANQFAIQNRDRIGGQVTHGDLIARVFFLPLFNKIVGKLTRL

SEQ ID NO: 13746 - protein, 348 aa, Klebsiella pneumoniae
GRDPMAKPIITLNGLKMVIMLGMLVIILTGIRFAADIIVPFILALFLAVIINPLVQLLVRCRVPRVLAISLLIGLIVMLAIVLLASLGTSLNELARTLPQYRNYLYEPMQTIAPWLQRMGFTVSVVELNKYIDPNAVMTLVTSLLTQLSNAMSSIFLLLLTVVFMLLEVPQLPAKLQQLMSRPVEGMGAIQRAIDSVSHYLVLKTAISLITGLVVWGMLVLLDVRFAFMWGLLAFALNYIPNIGSVLAAIPPILQVLVFGGLYEALVVLAGYLIVNLVFGNILEPRIMGRGLGLSTLVVFLSLIFWGWLLGPVGMLLSVPLTIIVKIALEQTSGGQSIAFLLSDVSKQ

SEQ ID NO: 13747 - protein, 146 aa, Klebsiella pneumoniae
RISPACRRRRRTRRPPPAADRAGCATEYPAATDRGSAPAPGQPPALSLLARPECPRRRRTAAPAAADAPRAAAAASAGARRGCPPASGQRSPAARAASRSVPASRYRDNDPPGEPGPPTAAQAESQRHPAPRAAGAPVRCRWRPGW

SEQ ID NO: 13748 - protein, 272 aa, Klebsiella pneumoniae
FPLPVAACACYGMKTQKALRNSKMIIMVTGATAGFGGSITRRFIANGHKVIATGRREERLKTLKDELGDNLYIAQLDVRNRAAIETLIADLPAEWQAIDVLVNNAGLALGLEPAHRASVEDWEDMIDTNNKGLVYMTRAVLPGMVERNRGHIINIGSTAGSWPYAGGNVYGATKAFVRQFSLNLRTDLHGTAVRVTDIEPGLVGGTEFSNVRFKGDDAKAEKAYENTQALTPEDVTEAVWWVATLPKHVNINTLEMMPVSQSFAGLSVHRQG

SEQ ID NO: 13749 - protein, 254 aa, Klebsiella pneumoniae
PTSLSGSHFVRTTNNSAITAHHWSDLMIDKSVSTLSEAIAGIHDGATIMIGGFGPAGQPTFLIDALIDQGARDLTIINNNAGNGEVGLAALLKAGRVSKMICSFPRQVDSQIFDDLYRRGKVELELVPQGNLAARIQAAGAGLGAVFTPTGYGTPLAEGKETREIDGRHYVLEYPIKADFALIKAHQGDRWGNLVYRKAARNFGPIMATAAKTTIVEVSQLVALGDLDPENIITPGIFVQRVFSLENLTAAQRA

SEQ ID NO: 13750 - protein, 215 aa, Klebsiella pneumoniae
MSRPSICSISTASIPRYRWKRWWALWPIWLKRVKFAISVCRKYLLRRCAGPARYIRSLPCRRNIRYGAASRKPGILHTCRELGVGFVPYSPLGRGFLTGTITDPGVLSADDFRRHLPRFQAETMRKNQLLLERLQQVATRYDATLAQIALAWVMSKGEDIVPIPGARKIAHLRDNAGAANITLAPEDILTIEHIFTADSVTGLRYTQGDFDLIEK

SEQ ID NO: 13751 - protein, 203 aa, Klebsiella pneumoniae
VMMPFPNRDAVALSARTLGALFSYAPNSAEIAPLVAAFQDGSWQQQWPFPVAAPLASGFAASAEETLPEAWQRLFIGPWALPAPPWGSVWLDKESVLFGDSTLALRQWMRENGIALEADGNEPEDHFGTVLLLAAWLCETEQDALFAQLLAWHLLPWSGRFLSVFVDHAAHPFYQALGQLAQATLAQWQENLPIAVAQKPLYR

SEQ ID NO: 13752 - protein, 165 aa, Klebsiella pneumoniae
NQPPGPPRSGFPPAPAAPALPPADPAASGAARRATRQRHRHRAAPGTRPPTAAPSRRRSRGQTAGAAQRRFAARTPRCQGNTGPSARVRWPPSGWFSPRQRPGRRGRLSPSGRCTPGRAPRSHPRQCAAPAPNGRYARRPSAPSPSQTGRRQSWCRWRRDQLAQP

SEQ ID NO: 13753 - protein, 368 aa, Klebsiella pneumoniae
PCQPAENSERWQYSGINGASACPEGAMSQDVTAKMLKPDFDSEVSGLVHGYLFHEQRPPQPIASGEVCARYQALADDKAFIWLHLNLNHATAEKWLTSHFPVADFFFEEIRSGSHTTRIERQGENLFAVLNDVLFRPQDTSAETATLWLYCSPRLVVTARFKPLRFIEWMLPRLQTLRVNTSTELLAFLLEEQEEVLEQVVRQASRHVDLIEERLLSNHVQRNRADLARLRRMLLRFQRLLAPEPAAMFRLLNRPPAWMDRAVVQAFRQFTEEFSVVLNDLSGLIERISLLQEEIGARQLEQSNRTLYTLTVITVLALPINIVAGFFGMNVGGIPLASNHHGFILLVVIVAVFTLGAGYLAFRRRDDL

SEQ ID NO: 13754 - protein, 191 aa, Klebsiella pneumoniae
TSRPAAGGDAVSAAFASRTAVVSEVTMQCLADIAPAEVRTIWGLLSAIPDPEVPVLTITDLGMVRSVARHGDGWVIGFTPTYSGCPATEHLLGEIRTVMSEHGFQPVHIVLQLDPPWTTDWMSQDARERLRQYGISPPQGHACHADMPAEVSCPRCGSTHTSLISEFGSTACKALYRCDSCREPFDYFKCI

SEQ ID NO: 13755 - protein, 568 aa, Klebsiella pneumoniae
QKRPFALITRLYVCRAIGDNNLSLNLPGVVMKASEHPPRVRQRALPLKLSTAVSLMIGSVIGAVLLLVYALWYMQISNATRDGLKETALAVARTMADMPQVKRGLEAPPQQQIIQPLAQAITRRNDLLYAIVTDMQGIRYSHPDSSIIGKPFIGHDIQPTLQGKENVAINHGVLAPALRVFTPVFNERHQQIGVVVVGISLSKVDEQIANSRWDVLLTILFSALVCALGTWSLVRGLKRVLLGLEPHEISTQFQQRQAMLHALKEGVVAVDAHGEVNLINPAAEEILFSGPDKTLVHSPLLDDLQTVLQSGEPMFDRELGCNGLLLIGNTVPIRSQGAVVGAICTFRDKTEVSQLLQRLDGMMSYVDALRTTSHEFMNKLHVILGLLNMKSYGKLEEYVLQTAHRYQADIGDIQHRIKSPVVAGFLISKIQRATECGFTLTLAEESLVPDCPNEKQVTVLVTVLGNLIENALDAMCGQAEGEIGLLLHYQDGWLSGEVSDDGPGIPENNIDAIFNKGFSTKGENRGVGLFLANQQLRELGGTLAVESEPGVFTQFFVHLPWDSKRKPA

SEQ ID NO: 13756 - protein, 398 aa, Klebsiella pneumoniae
ACRPGKAPAATGPKQASSLPPCLAGRQDRRVSGALVVQLKLPLAPLLQLPEAPQRDKPQRRSQQRQQRVRVKDHDEDSEREEQQAHPAHHHPGGHLKDRPGVQVRTLTAVNQIGHEDHPPAEHHHNRRQGRDDGEQGHHVRHQKQQQRADQHAEAGEQQAAHRNAGTARQDTKLPVRMLLHRQAVQHAGAGEDPAVGRGHRRGQRHKVNHRRGCRQPGLGEQRHEGAGLRRHPRPRGDSDDHHHRQQIEDNNPQRQSIDRLGQNALRIAGLRRHGAQQLNAGKGEDRYLEAGEKAGDAVGHKGRRVGEMAEGGRHAVRGGPAGGNHPAAGADQGDNGDHLDQGEPELRLAKHFHRQQVKQEQDRQHAEGRHPRRQFREPVLHIAPADHHVGDTGHHPA

SEQ ID NO: 13757 - protein, 408 aa, Klebsiella pneumoniae
YRRPSMPKYNIYTKIESNVSAVDLFYDLNVYRTDASNKKHILLSVAQQPVTSNYQTQSHETNDTEDGLSVIYIMEMNLYRKHGGKLFSVLSSPAKKMYTLGEMASGQAYSKNKRENVCYFETKAQTKPVNDKGEDNIHTVQITCQKRAFIAKEYPVGSPDDPFDKNKIEHQILSRMNRSSYPNQGDTSLCGPASFFYCLLMDRPDIYKQAVNELWLYGKTKIGALNIVPSNSCRHPMGAFYDAYGERVKGIDWITLASLRDSENSIMSYDEIDDQASGITLWGALTEWFVSAGYQKEFSNVGLSHVNLKELSTLNEYIRKGCRVVTLISAGILDGFDSTVTAKNHWIVWDGPITTQYGEVISLTTKENELVQLKLFSWGKVKNQIKRHLALSDVMGSIFGGVVFKSLE

SEQ ID NO: 13758 - protein, 195 aa, Klebsiella pneumoniae
VVKLIGNPFLLYHRHVSHQYIFNNYSLRKGTAMADTFQNEVPRARINLKLSLHTGGAQKKVELPLKLLTIGDFSHGKENRPLSEREKINVNKNNFNSVLSEFSPEVNLSVPNTLAGNGEEENVRLRFTDIKDFEPEQVARQIPQLRAMLAMRNLLRDLKSNLLDNATFRKELEAILKDPALSQQLRDEMSALAPK

SEQ ID NO: 13759 - protein, 232 aa, Klebsiella pneumoniae
SDITLEVAMCGRFAQAQSREEYLAHLVEAAERDIAWDPAPIGRYNVAPGTKVLLLNERDEQLHLDAVYWGYAPGWWDKPPLINARVETAASSRMFKPLWEHGRAICFADGWFEWKKEGNTKQPYFIQRKDGQPIFMAAIGRTPFERGDHAEGFLIVTAAADRGLVDIHDRRPLVLAPEAAREWMRQDVTGAEAAEIASDGAVSADDFTWHPVTRAVGNVKNQGPELLAPLIP

SEQ ID NO: 13760 - protein, 759 aa, Klebsiella pneumoniae
DEVTMANGLKFSPRKTALALAVAVVCAWQSPVFAHGSEAHMVPLDKTLQEFGADVQWDDYAQMFTLIKDGAYVKVKPGAKTAIVNGKSLDLPVPVVMKEGKAWVSDTFINDVFQSGLDQTFQVEKRPHPLNSLSAAEISEAVTIVKAAPEFQPNTRFTEISLHEPDKAAVWAFALQGTPVDAPRTADVVMLDGKHVIEAVVDLQNKKILSWTPIKGAHGMVLLDDFVSVQNIINASSEFAEVLKKHGITDPGKVVTTPLTVGFFDGKDGLQQDARLLKVVSYLDTGDGNYWAHPIENLVAVVDLEAKKIIKIEEGPVIPVPMEPRPYDGRDRNAPAVKPLEITEPEGKNYTITGDTIHWQNWDFHLRLNSRVGPILSTVTYNDNGTKRQVMYEGSLGGMIVPYGDPDVGWYFKAYLDSGDYGMGTLTSPIVRGKDAPSNAVLLDETIADYTGKPTTIPGAVAIFERYAGPEYKHLEMGKPNVSTERRELVVRWISTVGNYDYIFDWVFHDNGTIGIDAGATGIEAVKGVLAKTMHDPSAKEDTRYGTLIDHNIVGTTHQHIYNFRLDLDVDGENNTLVAMDPEVKPNTAGGPRTSTMQVNQYTIDSEQKAAQKFDPGTIRLLSNTSKENRMGNPVSYQIIPYAGGTHPAATGAKFAPDEWIYHRLSFMDKQLWVTRYHPTERYPEGKYPNRSAHDTGLGQYAKDDESLTNHDDVVWITTGTTHVARAEEWPIMPTEWAHALLKPWNFFDETPTLGEKKK

SEQ ID NO: 13761 - protein, 252 aa, Klebsiella pneumoniae
TLPTVDYFSPVYFIDKTVGLVMFKRFFITGTDTSVGKTVVSRALLQALAARGKSVAGYKPVAKGSKETPDGLRNKDALVLQSVSTLALPYEAVNPIALSEDESSVAHSCPINYGLLSDGLQRLAAQVEHVVVEGTGGWRSLMNDLRPLSEWVVQEQLPVLMVVGIQEGCINHALLTAQAIANDGLPLIGWVANRINPGLAHYAEIIDVLSKKLPAPLIGELPYLPRAEQRELSRYVDLDMLGNVMAIDRIPA

SEQ ID NO: 13762 - protein, 88 aa, Klebsiella pneumoniae
CWPTQTSIPLIWITTAIHPRKDLMFYLIFIEGIIRTTYRILFCNKRSFLTGNLHSMYIILTLIINRFCLRLCLKITNIFTLIFRICLP

SEQ ID NO: 13763 - protein, 130 aa, Klebsiella pneumoniae
YARLSGLFYSGAEMQLTLDTLKETGAFTGRPVEKEIKWKGRDGKEHIATVYVRPMGYHTTKAELLAYNGKSDPIAERIAAHICDQDGAPVFTAADILGTATPDRGALDGPIVMALLAAIHDVNELGKTTS

SEQ ID NO: 13764 - protein, 144 aa, Klebsiella pneumoniae
WRSTMSNDPWRNARVMYEKDTCARKMGIELIEMDDGFAQMSMTVSADMLNGHQTCHGGQLFTLADTAFAYACNSQGLAAVASAASIDFLRPAFAGDRLVATARVKQQGKLTGVYDIEIVNQQQKIVALFRGKSHRIGGTITGDV

SEQ ID NO: 13765 - protein, 206 aa, Klebsiella pneumoniae
TMSTQYGFFIDSARCTGCKTCELACKDYKNLTPEVSFRRIYEYAGGDWQEDNGVWQQNVFAYYLSIACNHCEDPACTKVCPSGAMHKREDGFVVVNEEVCIGCRYCHMACPYGAPQYNADKGHMTKCDGCHERVAEGKKPICVESCPLRALDFGPIAELRAKHGQLAAVAPLPSAHFTRPSIVIKPNANARPCGDTTGYLANPKEV

SEQ ID NO: 13766 - protein, 65 aa, Klebsiella pneumoniae
TGITATLFFIFHLILLFFVIFIVSCSGATRLFLDVSCYFKMVTNRRRYASRQAAFMIAKASSPLG

SEQ ID NO: 13767 - protein, 318 aa, Klebsiella pneumoniae
YVVTKVVIMASYDLVERLNNTFRQIELELQALQQALSDCRLLAGRVFELPAIGKDAEHDPLATIPVVQHIGKTALARALRHYSHLFIQQQSENRSSKAAVRLPGAICLQVTAAEQQDLLARIQHINALKATFEKIVTVDSGLPPTARFEWVHRHLPGLITLSAYRTLTPLVDPSTIRFGWANKHVIKNLTRDQVLMMLEKSLQAPRAVPPWTREQWQSKLEREYQDIAALPQRARLKIKRPVKVQPIARVWYAGEQKQVQYACPSPLIALMSGSRGVSVPDIGELLNYDADNVQYRYKPEAQSLRLLIPRLHLWLASE

SEQ ID NO: 13768 - protein, 225 aa, Klebsiella pneumoniae; identical to SEQ ID NO: 11424

SEQ ID NO: 13769 - protein, 128 aa, Klebsiella pneumoniae
SASTSTAPAVFLCPQFAAGQGKYMSTTIEMLRAQCRIDIDDATEDELLTLYFTAARRRAENFINRKLHEDSVPDTDPDGLKIADDILLALMLLVGHWFNSREEASDVNKMSIPFGFTSLLEPYRYIPL

SEQ ID NO: 13770 - protein, 128 aa, Klebsiella pneumoniae
SLKTQDFCMMKYVVLLALSLFTSLSGWAFSLDNADIRLLCPQRGQIKVILHRYEHTQQSWGQHHFETGGGHVRQGPLLVIPFANLDQMIYHQTTGEFAYWYAETEKLVRCRLLSLTTTYPVDIPYYRE

SEQ ID NO: 13771 - protein, 206 aa, Klebsiella pneumoniae
KKETPMSKVLVLKSSILAGYSQSGQLSDYFVEQWQEKHPGDEITVRDLAANPIPVLDGELVGALRPSDAPLTPRQQEALALSDELIAELKGNDVIVIAAPMYNFNIPTQLKNYFDLVARAGVTFRYTEKGPEGLVTGKRAVVVTSRGGIHKDTPTDLVTPYLSTFLGFIGITDVNFVFAEGIAYGPEVAAKAQSDAKAAIDSVVAA

SEQ ID NO: 13772 - protein, 108 aa, Klebsiella pneumoniae
CKRTGKDYELTGEDEFWCELVMNGIGGRTIAEAQERMSRREFLVWLKYREKYGPLNIMMRTEWGASLVASVLANINKAKNTPPFKVSDFAPHINEAPLSLEEAMKSWH

SEQ ID NO: 13773 - protein, 848 aa, Klebsiella pneumoniae
WRLTRGQYPMSSVKSLLFSHNHHLLSVKGCEAGLDVLAFEGDEALSQPFRYRIEFTSADHAISKEMMLMKAASLTLQAPVAQGFGINVQQPVRVIQGVVTGFERLSTSRDETHYALTLQPRLALLNRSHQNAIYQDQSVPQIVEKILRERHGLRGQDFLFSLTKTYPRREQVMQYGEDDLRFITRLLGEVGIWFRFTTDTRLHIDVAEFCDSQQGYEKGLTLPSVPPSGQQSAGVDGVWEMACRHRVVEQQVSTRDYNYREATADMNAQVDVTRGETTTFGEAYHWGDNYLTAGNVHDRHPAPESGSFYARLRHERYLNGQTRMQATTSCPTLCPGQVLKVTGGEEVAGEFADGVLVTAMHSHARRDADFAVEFAGIPDSPDVGYRPEPGARPVMAGTLPARVTSTRENDTYGHIDKHGRYRVNMLFDRARWETGFESLWVRQSRPYAGDTYGLHLPLLAGTEVAIGFEDGNPDRPYIAGVLHDSAHGDHVTIRNDKRNVLRTPANNKIRLDDERGKEHIKLSTEYGGKSQLNLGHLVDSDRRPRGEGFELRTDSRGAIRAQKGIFISADGQAQARGQVLDMEPAVSNLAEAREQMMSISGDAQKATANPADLQAQITLLEQQLTDLKKSVLLVSAPEGIALTSGEHLQVSAGHNLIATAGKNADVSVVKNLFIGVGSALSVFVRKLGIRLIANQGPVQMQAQNDLMALLARKEISIVSTEDSIEIIAKKRVTINGGGSYITLNASGIESATAGEYRTRAGYYVRREKAQHKPDIAPLANAINDGSHNIRYLCTDDNGMPMLNTPYRAFLADGSVLEGVSDGEGYTKLFTSAQVQDVLLHMIPEAINA

SEQ ID NO: 13774 - protein, 78 aa, Klebsiella pneumoniae
GAMTADQIIEGILGKEGGYVDHPSDKGGPTRWGITQTTARAHGYTGDMRNLPRETAKQILLSDYWTGPRFDQVAALST

SEQ ID NO: 13775 - protein, 97 aa, Klebsiella pneumoniae
TRSTQLHTCPELITRESTTAFTASSRSASSITMAGALPPSSRHTLVIFFAAAAIIFSPAATLPVMLTIATFGLPASSWPTVSPRPSTRLKTPFGNPT

SEQ ID NO: 13776 - protein, 1189 aa, Klebsiella pneumoniae
NRPTNTIPADDYLRGYHSESAMEHAYYPDSFKTGDGSVKLLLAPKTTEGRYLSVVFILFLLLAAMTFIVWKHPDMAGLEGDSQQQNYWLIGGCCITGCIFIMLVMLLWTARSAGKKEFEALLDVTRGDDNKRKDESENISVSPAVVMCARIRDHLRTRIGIHWRRKVRLLLVTGDEAAIEQLVPGLRQQRWLEGQRTVLIYGGSLLSEPDSQQYAALRKLRRGRPLDGIVRVMPSSLTLTPLISESDLHGLEKISELLGYAAPVWLWKLCDSEWPQADRAVQAVGVSFPLRATEDDVARQLAQMLPTLREQGMHQIAEETRHDFLLRLGQQLIDGEIAQWRRQLAPWLTASRQRLALRGLMFSLPEPRAVDPYQEADTSPAGQPHLLTLPATWQGIVDDCRRLRGHHVGMAWERGLACGLLAILGLWAAGLLLSFALNYSQIASVAGKARDLVAHPSVSDYQLTALHALRNEAGRLVHDGQKGAPWYRRFGLDHHQQLLNAVLPWYGVANHRLIRDPANAALQQALNALVNSAPNSDQRARLAKPGYDQLKAWLMMARPDKADGAFFAQTMKTVQPTRMGISTGLWQSLAPDLWAFYLSLLPERPEWKIIPDAQRVSQSRQVLLQQLGRRNAESTLYENMLKSVRRNFADVSLEDMTSGTDARRLFTTDEVVPGMFTRQAWEGGIQQAIDKAASSRREEIDWVLSDSRKTVSTDLSPEALKARLTRRYFTDFAGSWLNFLNSLRLNPATNIADVTDQLTLISDVRQSPLIALMNTLAWQGQAGQQREGLSDSLIKSAKDLVGGKDKPVIDQSAAGPQGPLDDTFGPLLQLMGKNTGSNVMSADSTLSLQTYLTRITRVRLRLQQVANASDPQEMMQTLAQTVFQGKSVDLTDTQQYGSLISASLGEEWSGFGNTLFVQPLTQAWETVLLPSAASLNDKWRRSVVANWHTAFDGRFPFAASKSDASLPMLAEFVRKDSGRIERFLTTELNGVLHKEGSQWVPDKVNSHGLVFNPAFLRAINQLSQLSDILFTDGSQGISFELQARPAPEVVETQLTIDGQKLRYFNQMADWQTFRWPGETYKPGTLLTWTTVNAGTRLFGDYSGTWGFIRWLEQGKRHPLDRSQWMMSFSAPDGRTLQWVLRSQLGSGPLALLALRGLTLPDQIFTVDAAESAQTLTTGLGNSDMDEMEL

SEQ ID NO: 13777 - protein, 301 aa, Klebsiella pneumoniae
LSTTSAPRRASPVFVLNRFLRRPLMRNDRSFIELRARERAHALLDDGSYRELLDPFDGIMSPWLGAQGIVPQSDDGMVVAKGTINGQPAVVIAIEGTFQGGSMGEVSGAKMAAALELAAEDNRNGIPTQAVLCLETGGVRLQEANLGLAAIADIHAAIVDLRRYTPVVGIIAGTVGCFGGMSIAAALCSYLIVTREARLGLNGPQVIEQEAGIEEYDSRNRPFIWSMTGGEIRAASGLVDALVNDGVNAVKTAMNEAIAKGVPVQHRSDNYDDYLRRLSQFDTRQQADTAQIKQLFAREDK

SEQ ID NO: 13778 - protein, 474 aa, Klebsiella pneumoniae
MMTTSLVNVAVIGSGTMGAGIAEVAAAAGHPVRIFDINPKAVDLAIEGIAGRLASRVARGKLASEQADALLARLHPAHDLAALADADLVIEAASERLEVKTALFAQLAAICAPSTLLTSNTSSISITAIAAGVKNPERVAGLHFFNPAPVMKLVEVVSGLATSTEVVEQLCQCVSGWGKQPVRCRSTPGFIVNRVARPFYAEAWRALEEQVAAPEVIDAALRDGGGFPMGPLALTDLIGQDVNFAVTCSVFNAFWQDRRYLPSLLQQELALAGRLGKKSGHGVYRWPAETLPDAALPPVMIGAESVTVRSDNVTELDDVLLLETEGETALALSIKHHRPVVVYDLCASDTVVLAAAATNAPAATDKAVHYFQQQGKKVLRIADYPGLLVWRTVAMLINEALDAVQKGVASPQDVDTAMRLGVNYPHGPLAWGERLGWRRVLQLLENLQHHYGEERYRPSSLLRQKALMEKHHEQ

SEQ ID NO: 13779 - protein, 549 aa, Klebsiella pneumoniae
PLKTGYSWPTLTGIAARTDHNNRRQYGSRPAQHNNDNRGMPMSMSSIPSSSPGGKRYGWVEKIGNKVPHPFLLFIYLIAVLIAATAILSALNVGVQNPTDGSRVVVKNLLSVEGLHWFLPNVIKNFSGFAPLGAILALVLGAGFAERVGLLPALMVKMASHVSARYASYMVLFIAFFSHISSDAALVIMPPLGALMFLAVGRHPVAGLLAAIAGVGCGFTANLLIVTTDVLLSGISTEAAKSIDASLHVSVIDNWYFMATSVIVLTLVGGLITDKLVEPRLGQWQGSRDEKLQTLTPGERFGLRIAGVATLVFVAVIALMVVPENGILRDPVQHTVMPSPFIKGIVPLIIFFFFVVSLAYGIATGKIRRQADLPQLMIEPMKEMAGFIVMVFPLAQFVAMFNWSNMGKFMAVGLTDLLESSGMNGVPAFVGLALLSAFLCMFIASGSAIWSILAPIFVPMFMLLGFHPAFAQILFRIADSSVLPLAPVSPFVPLFLGFLQRYRPDARLGTYYSLVLPYPLIFLAVWLLLLVGWYLVGLPIGPGIYPRLS

SEQ ID NO: 13780 - protein, 122 aa, Klebsiella pneumoniae
SLRTAVLATLLVALVAIIHLAILVLEMFLWEGSAGRRAFNLSADFARQTRVLAANQGLYNGFLAAGLAWGLWLGAPGVQVVIFFLACVLAAGIFGALTASRKILYIQALPALLALVAVLTQA

SEQ ID NO: 13781 - protein, 72 aa, Klebsiella pneumoniae
ATRTNTAINKEIPVNVFVFFKMIRHFFLDYLYSSTNDFLLSEEGARQVLFLKRKEYYLPSTSQQISHVHKID

SEQ ID NO: 13782 - protein, 375 aa, Klebsiella pneumoniae
RRGASVAGVSTAFRRRSAISSCRCWRRPATARADPGWRGCEPLEAGSAMIPTFVVWSQSMFNDAIVYDRYGPPAAVLTLKRLPLAPLAGGRVRVRMRFAPVNPSDLIPVTGAYRHRTRLPAVAGYEGLGEVVAAPYGSRLAAGQRVLPLRGGGTWQRFIDLDETWLVPVPPAVDDLLAARGYINPLTAMLMLKRWPVAGRHLVLTAASSSCASLLGQWALAMGARSVSGIIRSPQHRARLEQAGIYPILDTDRALMEKVSQHSDLVFDAVGGELANTLLSVLSASSTLISYGLLSGRPLTQTRGSATVRKFHLREALPTLSVAAWRAAFDEIWQRLPTTSQPPAQRIALNDWRAAIAAAGQPGRGGKILLDFTAG

SEQ ID NO: 13783 - protein, 404 aa, Klebsiella pneumoniae
SPSATEGALAKEAPMFDFATPIDRHGTWCTQWDYVADRFGAADLLPFTISDMDFATAPCILDAVSQRLAHGVFGYSRWRNEAFLGAIAHWYASRFNSDIDPQSVVYGPSVIYMVAETIRQWSKEGDGIVVHTPAYDAFYNTITANRRRIAPVPLILKDNRWRCDMERLEAALAEPKNTLLLLCSPHNPTGKVWRREELETMAALCQKHGVRVISDEIHMDMTWGEHRHIPWSEVAQGPWALFTSGSKSFNIPAFTGAYGFIPEENERDSYLQALKGRDGLSSPSVPALVAHIAAYRDGAPWLDALRDYLQANMRYVADTLNNAFPALCWQPPEATYLAWIDLRPLNVDDRALQQALIAEQKVAIMPGYTYGPEGNGFLRLNVGCPREKLERGVEGLIAALRSLS

SEQ ID NO: 13784 - protein, 182 aa, Klebsiella pneumoniae
VCYFFQFRRGGRMTDEIDSDANNTHELTAEVARALIARGWRLTTAESCTGGNLAAALCAQADTAAFYDTGVVTFSDEAKRNVLQVRAETLAVHSAVSEACVQEMSSGILALAGADIAIAVSGYAGPEGGEDGTPAGTVWFAWNFRGQTETKRMCFAGDCETVVAKAVRYALAALSEKLAHWQ

SEQ ID NO: 13785 - protein, 436 aa, Klebsiella pneumoniae
NPCAGQVAASRPGDHRFAPTGYHNLSAGLQRRRGGSSRRVLGTGGPLTPQPAARRAFYFRISRPRLAARCRKCRKDADIPPLNPYHTRHGCLSNLNNCYASAPRCSAAGRMRALLMPHYELSHYYMLQNQEISKKEKYNIDKLQKRLRRNVGEAIADFNMIEEGDRIMVCLSGGKDSYTMLEILRNLQKSAPISFSLVAVNLDQKQPGFPEHILPAYLEQLGVEYKIVEENTYGIVKEKIPEGKTTCSLCSRLRRGILYRTATELGATKIALGHHRDDILQTLFLNMFYGGKMKGMPPKLMSDDGKHIVIRPLAYCREKDIERFSQAKGFPIIPCNLCGSQPNLQRQVIADMLRDWDKRYPGRIETMFSAMQNVVPSHLSDVNLFDFKGITHGSEVVDGGDLAFDREDIPLQPAGWQPEEEDARLDELRLNVVEVK

SEQ ID NO: 13786 - protein, 147 aa, Klebsiella pneumoniae
IFRAIPRSPPSSSLARLASTSFIFILLWVPEPVCQIASGNSCACFPASTSSAAATIAPAFSAVNSPRSWLTFAAARLVSARAYISSPGIFSVEMRKCSSERWVWAPQSLSAGTSMAPIESFSLRCVVITFSLDEKCVIATKLTCLKD

SEQ ID NO: 13787 - protein, 218 aa, Klebsiella pneumoniae
NGRATRLTIKPGVERQRTGCFPQPLTHWHSCSTTSVEVARPLTTSTSFITGAGLKKCSPATRSGFLTPAAIAVIEIDEVLLVNSVDGAQIAASCANSAVLTSSRSEAASITKSASASAAKSWAGCRRASSASACSDASLPRATRDARRPAIPSIARSTALGLISKIRTGCPAAAATSAMPAPMVPLPITATLTKDVVIIYFPLNCGGRLARNALTPSR

SEQ ID NO: 13788 - protein, 63 aa, Klebsiella pneumoniae
STGAIVIFSKSRPFPARLLRAPGDGFRQVCFYYLRTNVLPAGAHAIANQLRAAAVFRAQAALQ

SEQ ID NO: 13789 - protein, 92 aa, Klebsiella pneumoniae
NPGAASPPPDGSAPNGCLRRPAPGWPAHGHSATASNAAPAADLPPAPPAPPVDQTALPAGKRHPSHRRSSVRYQRGAPHPALTARPPAARAG

SEQ ID NO: 13790 - protein, 327 aa, Klebsiella pneumoniae
LTVAAVVRRPCMAKYQSMLVVIDPNQDDQPALRRAVYLHQRIGGRIKAFLPIYDFSYEMTTLLSPDERTAMRQGVIAQRTAWIREQAKFYLESGVPIDVKVVWHNRPFEAIIQEVVSEKHDLLLKMAHQHDKLEAVIFTPTDWHLLRKCPCPVWMVKDQPWPEGGKALVAVNLASEENYHNTLNEKLVRETLSLAEEVNHTEVHLIGAYPVTPINIAIELPDFDPSVYNDAIRGQHLLAMKALRQKFGIDEKFTHVEKGLPEEVIPDLAEHLQAGIVVLGTVGRTGLSAAFLGNTAEQVVDHLRCDLLVLKPEAYQTPVELDDDDDD

SEQ ID NO: 13791 - protein, 236 aa, Klebsiella pneumoniae
CHSAIKENKMKTRYLGKEKFQVSALGLGCMGMSFAYGGAETSQAINTIHAAMDMGVTFLDTAEVYGPFDNEVLVGKAIKGFRDKVQIATKFGFRILPTGQGLERMAGVDSRPAHIRESVEGSLKRLNVETIDLLYQHRVDPAVPVEEVVGTMADLVKEGKIRHIGLSEVSAQTLRRACKVHPIAAVQTEYSLWSREPEARYSPHLPRAGGRLCAIQPAWPRLPDGDNYRSRRFVSG

SEQ ID NO: 13792 - protein, 423 aa, Klebsiella pneumoniae
WGSARVDAAVFTRHQDALAGHDIGGGAQRTLFLGGFIPDVHDSVGHNAVHLGVDLLFTPEEAGHVLYPLKVADGHPAGVADNVRHHDHAALGQHVVRFRIGWAVGPFQHQFAGQLLSALAGDLPFQRRRDQDVHRGGPEGVFIDLLGARETGNLLFLRLPGGEGGHIDSAFVIQGRGMILNNHDTSADASEQAGRFATDVTKALQRHFGAFNFDTGATGNFPAGDKHSASGGFFTTEGAAEVDRFAGDHAGDGGAMVHGVGVHHPCHHFAIGADVRRRNIFLRPDNNADFAGVAAGQTLQFTFRQGEGVDADAAFGPAVRNIDRGALNGHPGRKCHDFVKIDIRMVANTTFTRSARQIVLNAIALEVADGAVVHLHRNVDDQRAFRMAQGFHPVGKIAEIRRDAVDLAQVGGPWRCTTFRCVR

SEQ ID NO: 13793 - protein, 206 aa, Klebsiella pneumoniae
TMSATPRPHDLVWLNHASALEDIAEPWVAQQWRAALPVLVRRDVDDQARVPVGVRGMKREQRAAGWVQARNIVRSVTPEMLVDREVLLHSPFVSQPPVQGAIALTLHRWPWGWGVTGSTGYALATEIPVLHAASDLDLLIRAPQPLDREALLEWQTRVAQLPCRADTQVETPYGAFALNEWLRDGRALLKTSRGARLTATPWHREE

SEQ ID NO: 13794 - protein, 196 aa, Klebsiella pneumoniae
LATAAGGEPMNLDDKSLFLDAMEDVQPLKRNNDVHWHPGRNSRAPQRVDTLQLDNFLTTGYLDIVPLATPLEFKREGLQSGVLDKLRRGKYSQQASLSLLRQPVEQCRQMLFAFMVQAQKEGLRNVLIVHGKGRDDQSHANIIRSYLARWLEELPEVQAFCAALPHHGGSGACYVALRKSAQAKQETWEQHAKRSR

SEQ ID NO: 13795 - protein, 557 aa, Klebsiella pneumoniae
SAKAVSESTMSNKPFVYQDPFPLKKDDTEYYLLSSDYVSVAEFAGQEVLKVDPQALTLLAQHAFHDASFMLRPAHQQQVADILNDPEASENDKYVALQFLRNSDIAAKGILPTCQDTGTAIIMGKKGQRVWTGGGDEAALAQGVYNTYIQDNLRYSQNAPLDMYKEVNTGTNLPAQIDLYATDGDEYKFLCIAKGGGSANKTYLYQETKALITPAKLKNYLVEKMRTLGTAACPPYHIAFVIGGTSAEATLKTVKLASTKYYDGLPTEGNEHGQAFRDVQLEQELLLEAQNLGLGAQFGGKYFAHDIRVIRLPRHGASCPVGMGVSCSADRNIKAKINRDGIWIEKLESNPGKYIPEHLRQAGEGEAVKVNLNQPMSEILAQLSQYPVSTRLSLSGTIIVARDIAHAKLKELIDNGEALPQYVKDHPIYYAGPAKTPDGYASGSLGPTTAGRMDSYVDLLQSHGASKIMLAKGNRSQQVTDACHKHGGFYLGSIGGPAAVLAQQSIKSLECVAYPELGMEAIWKIEVEDFPAFILVDDKGNDFFQQIQTSQCARCVK

SEQ ID NO: 13796 - protein, 489 aa, Klebsiella pneumoniae
LSLAAGGVMESIFQFVDEVVEAQRDTYCAIADDIWDHPETRFEEFWSAQRLADALEAEGFQLTRDAGGIPNAFIASVGEGQPVIALLGEFDALAGLSQQAHSAEPTPLTPGANGHGCGHNLLGTAAFAAAVAAKGWLQQHGDSGTLRFYGCPGEEGGSGKTFMVREGLFDDVDAALTWHPEAWAGMFSTRTLANIQAAWRFTGTAAHAANSPHLGRSALDAVTLMTTGSNFLNEHIIEKARVHYAITDTGGVSPNVVQAQAEVLYLIRAPEMADAEQIFARIEKIAQGAALMTETQVSCRFEKACSSYLPNRTLEAAMYQAVCHYGTPAWSDEERAFAAAIRATLSANDINNSLNNIAGTSGEEGKTFARRHRDTLLIDEVAPWAATDNVLAGSTDVGDVSWKAPVAQCFSPCFAVGTPLHSWQLVSQGRTSIAHKGMLLAGKVLAATAIRLFSDSALLAASQQELRQVLAERPYRSPIPAEVSPSVLR

SEQ ID NO: 13797 - protein, 230 aa, Klebsiella pneumoniae
PSMAAESQLNPTQPVNQQIYRILRRDIVHCLIPPGTPLSEKEVSVRFAVSRQPVREAFIKLAENGLIQIRPQRGSYVNKISLSQVRNGCFVRQAIECAVVRRAAGMINEEQLYQLEQNLHQQRIAVDRQQLNDFFLLDDEFHQKLSIIADCQLAWETVENIKAAIDRVRYMSLDHVTSPEMLLRQHHEIFTALEKRDAEAVEKAMSIHLHEISESVLLIRQENRDWFSEE

SEQ ID NO: 13798 - protein, 64 aa, Klebsiella pneumoniae
FRMAPLVPEPSPRLRDTFPPAGKEGEQVLLRALNCSQGARYLELAEGREANEDFLYGWVKERVL

SEQ ID NO: 13799 - protein, 125 aa, Klebsiella pneumoniae
LSPAPRKKRLPSRRWPMQQFEWIHAAWLAIAIVLEIIANVFLKFSDGFRRKIYGILSLAAVLGAFSALSQAVKGIDLSVAYALWGGFGIAATIAAGWVLFGQRLNNKGWAGVILLVAGMVLIKLA

SEQ ID NO: 13800 - protein, 148 aa, Klebsiella pneumoniae
KPTAKSRNLRGKIMAEKLSAHCHCGAVAFTVELSDGFNTVRRCNCSYCRMRGAVAVSSPRSGIEVVRGGDKLTEYRFNTGEAVHFFCSVCGIYTFHQRRSNPQQYGVNVACIDGVSPFDFPCVEVNDGVNHPKDGGGGVVGYLRYEKK

SEQ ID NO: 13801 - protein, 429 aa, Klebsiella pneumoniae
RRAARIAGRLPKTISSACVSGCRPWLRSWVSCSSSSIGAVSLPCTPAERIVAWRHGAVGSSCKMPSPSQRASMPAGKVHACRRQCSKSLTRCSICRSLTLKIIDRAQAQDLRQLIQRLINLAQQLRVRQIAGMQPVAIVFFHPCRQLLITFVVHQAMGVDRLALRLIEHHPQPQTGRAAAVAHAFPQVKDRHFIDRRCAIGGEIAEIAPDVFPLAALLRHHDQHLAVWFAQQLAVEQVRGHGVVERNPLVRHFHAGERDIQTVAFSPQRGQHCRLIDKRLLMVEQHMAIADRDDVVMKHAAIDSLRRLLGKHRVARIQLMQAGHRFAGLEGLPRRILHRGDTAAGASTIDEKLHPLPAIFPAEAVMVGRPFIAEVAMLRQRRMVGKVARIGERGAKDRRGGGCLLHTVQLIVQVGDGEMDFAIGAVRRR

SEQ ID NO: 13802 - protein, 424 aa, Klebsiella pneumoniae
GGQAIIAVIGHRQRLIEGRKGHHRQHRTEGFLMDNVHLLTYIQQQGRRIKIAFALQRLTAQRHPRPLRHRLRHFARHLVPRRRVDQRPHRDVIPCRRVAKLDGLHRLTEAVDEAVVYSLLNIDPLDAVTHLPGVNHPRVHYRFHRQLQIRIVHYNGRRFAAELEAHFGDIFRRSGHNFFSRRHAAGHADHRHLRIAGQLLANGFSAAKHKVKDPFRQPNLMDNLGKGDGIIGRKFAGLNDDGISSDQGRRQLAGDKKEWEVPRQDPGGHPQRAFKDKDILPRAIALHDLTFVTARPFCHIVEIIRGERNLHRRQLLDLAAFSDNQPGDLVGTLADTGGNFAQPARTLNGRQRFPAGLGALGGVNRQPRLFGSPVRDPRQQRFGRRVKHVDPAVAATGNELAINIHRVLNGCCHGYSCGAFVFNR

SEQ ID NO: 13803 - protein, 105 aa, Klebsiella pneumoniae
TIHLTSNHLSLNTVYSTSTKVIIMRVEISIAKEKAAKMPKGSMEALKDEMTRRISKQYDDVEVIVKTASNDGLSVLWATDKEIAKEFVETTLKDAWETADDWFVR

SEQ ID NO: 13804 - protein, 320 aa, Klebsiella pneumoniae
FMTYVIIHALAPIFVIMLLGFWAGKAGMVDNKNVSLLNIFVMDFALPATLFSATVQTPWAGIVAQSPLVLVLTGAMWITYAAIYFLATSVFKRTPQDAAVLTLTVALPNYAALGLPILGSVLGEGASTSLSVAVSIACGSVLMTPFCLLILEREKARAAGENSGSTLAMLPVLMWRSVKKPIVWGPLLGVVLSAIGIKMPDLLLASIKPLGLAATAAALFLTGVILSARKLQLNALIATSTIVKLLVQPFIAWGLVMLLGLHGSIAITAILMIALAAGFFGVVFGNRFGVQSPDAEAVLLLSSVLCILSLPLFISLTSGL

SEQ ID NO: 13805 - protein, 92 aa, Klebsiella pneumoniae
HSCYDRSRGVRTSALSMQDEYGLTLKEGEADMYKHSTNRDVRYAERELHFVIPSTVQGITHLAIFFSSSMQKDANRPLIPSSDTGAASYFTC

SEQ ID NO: 13806 - protein, 501 aa, Klebsiella pneumoniae
RRGYTSSKRAITPSLPAINLPIVTFNPKLLNNYTTFSHQVAPCSYRVTPDLSTVAGERFVMSNPQDNTASILQKNKKVLIASLTGSAIEWFDYFLYGTAAALVFNKIFFPMVDPVIGLILSWLSFSLTFFIRPIGGVIFAHIGDRIGRKKTLVLTLSLMGSATVAIGLLPTYEMVGLWAPALLITLRIIQGMGIGGEWGGALLLAYEYAPEKRKGFFGSIPQAGVTIGMLMATFIVSLMTLFDEAQFLAWGWRIPFLLSSVLVFLGLWIRKDIDETPAFKQVKKSGQVAKAPLRDTLKHHWREVLIAAGLKVVETAPFYIFSTFVVSYATTTLSYQKSQALESVTLGALVATVMIPLMGLLSDKVGRQKMYTLSVVLLGLFIVPWFLLLDTGTGWGIMLATIVAFGILWAPVTAVLGTLCSEIFSANVRYTGITLGYQLGAALAGGTAPLIATGLLAKYDGDWRPVAIYLGITVAISLLAIFCASRMKSALGTAPSRAESA

SEQ ID NO: 13807 - protein, 92 aa, Klebsiella pneumoniae
FCILTGYFVISGTKPPYKHGFAVVIQNSFTRNFIYQRDDKPKKIYQDKNVPVHQLDRLAGQMPLHVGNKVIEIENVLGAAFIKINTARRAVF

SEQ ID NO: 13808 - protein, 329 aa, Klebsiella pneumoniae
QLIYSERGVSWKLTMKTLPDLQQIEILILIVKHGSFRQAAKALNLSPPALTVAINHLEEKLGVRLLNRSTRSLSLTAVGEEFLNNITPVVNDYRRVVDSLNYHRLTPEGVVKVNLPRIVIDLFFQDYFIAFKNACPNVTLELYATDRKVNIIESGFDAGIRYSQDVPKEMIAIPFGEKLSLIPVASPDYIREAGEPDTPQSLVNFRCINRCFPGGEKYRWEFIGPSGELSEVAVKGDLVVDADSAMIQAAESGLGIAFVYQSLVTQQLSAGSLVHLLPDYRYPADHFCVYYPSRKHIPAPLRAFIAWVMAQNKNILGQQTARHGSRPED

SEQ ID NO: 13809 - protein, 425 aa, Klebsiella pneumoniae
GGYYLPPLVGHRPLIPPEFRGIFMTWQSFKQAWLIRFWSPVPAVIAAGILSTYYFGITGTFWAVTGEFTRWGGQLLQLLGVHSEQWGYYQLIHLEGSPLTRIDGRMIIGMFGGCLAAALWANNVKLRLPRSRIRIAQAVAGGIIAGFGARLAMGCNLAAFFTGIPQFSLHAWLFAIATAIGSWFGARFTLLPLFRIPVKIQKVSTASPLTQKPQQARRRFRQGMVVFFAMIGWGLLTAADHPALGLAMLFGIAFGLLIERAQICFTSAFRDMWITGRTVMAKAIIFGMAASAIGIFSYVQLGMAPKIMWAGPNAAIGGLLFGFGIVLAGGCETGWMYRAVEGQVHYWWVGLGNVIGSTLLAWCWDDIAAPLATHWQKVNLLNAFGPFGGLLATYLLLLIALLLVIAWERHFFRRQAAVRTVKESA

SEQ ID NO: 13810 - protein, 1179 aa, Klebsiella pneumoniae
GCLHMITIDGNGAVASVAFRTSEVIAIYPITPSSTMAEQADAWAGNGLKNVWGDVPRVVEMQSEAGAIGAVHGALQTGALSTSFTSSQGLLLMIPTLYKLAGQLMPFVLHVAARTVATHALSIFGDHSDVMAVRQTGCAMLCASSVQEAQDFALISHIATLQSRVPFIHFFDGFRTSHEINKIAPLADDTIRALLPQDKIAEHRQRALNPEHPVIRGTSANPDTYFQSREATNPWYDAVYDHVEKAMDDFAAATGRQYKPFEFYGHPQAERVIVIMGSAIGTCEEVVDELLSRGEKVGVLKVRLYRPFSAAHLLAALPESARAVAVLDRTKEPGALAEPLYLDVMTALAEAFNRGERETLPRTIGGRYGLSSKEFGPECVLAIFSELQAAQPKPRFTVGIYDDVTNLSLPLGENTLPAEAKLEALFYGLGSDGSVSATKNNIKIIGNSTPWFSQGYFVYDSKKAGGLTVSHLRVSEKPIRSSYLISQADFVGCHQLQFIDKYQMAERLKPGGIFLLNTPYSADEVWSRLPQEVQATLNQKKARFYVVNAAKIARECSLGARINTVMQMAFFHLTQILPGDSALAELQAAIAKSYSSKGQELVERNWQALALARESLAEVPLQPVNASSPNRPPVVSDAAPDFVKTVTAAMLAGLGDALPVSALPPDGTWPMGTTRWEKRNIAEEIPIWKEALCTQCNHCVAACPHSAIRAKVVAPEEMENAPASLHSLDVKSRDMRGQKYVLQVAPEDCTGCNLCVEVCPAKDRQNPEIKAINMMSRLEHVEEEKVNYEYFLNLPEIDRSKLERIDIRTSQLISPLFEYSGACSGCGETPYIKLLTQLYGDRMLIANATGCSSIYGGNLPSTPYTTDANGRGPAWANSLFEDNAEFGLGFRLTVDQHRQRVMRLLSEFADKLPAELNAALHAEATPEVRREQVAALRQALAGVAGAEELLTDADALVEKSVWLIGGDGWAYDIGFGGLDHVLSLTENVNILVLDTQCYSNTGGQASKATPLGAVTKFGEHGKRKARKDLGVSMMMYGHVYVAQISLGAQLNQTVKAIQEAEAYPGPSLIIAYSPCEEHGYDLALSHDQMRQLTATGFWPLYRFDPRRADEGKIPLALDSRPPSDALAETLLNEQRFRRLNAQQPEVAEQLWKDAAADLQKRYDFLAQLAGKAEKSPSEG

SEQ ID NO: 13811 - protein, 124 aa, Klebsiella pneumoniae
CKSHKDLIMPALIPRACRKRGCAGTTTDRSGYCEKHRNEGWQQHQQGKSRHERGYGSQWDIRRARILKRDNHLCQNCLRSGRAVAAKTVDHIKAKAHGGTDDDSNLESLCWPCHRTKTGRERIK

SEQ ID NO: 13812 - protein, 267 aa, Klebsiella pneumoniae
IMSQYPNRAALWLNKLAPDAPLMSGLCPSVQVADGQINGENVRFIAVVPDANNHYPRAAGGEVGLLEGWTLAKVVNETIAADADQPVKRPIVAVIDVPSQAYGRREEAFGIHQALAGAAGAYAKARLAGHPVIGLIVGKAMSGAFLAHGYQANRLIAFNDSGVLVHAMGKASAARITLRTVEALEKLAATIPPMAYDVSNYATLGLLSALLDINNPDAPDDHDLSLVSNTLRDAIADARTDTSLKCRLGAENRRSSQLVRDRMRASW

SEQ ID NO: 13813 - protein, 99 aa, Klebsiella pneumoniae; identical to SEQ ID NO: 9315

SEQ ID NO: 13814 - protein, 123 aa, Klebsiella pneumoniae
GLTHHLKEIVMNMTLNKRWCLTAILALSAVVYTSSSYAATDRLVIESGDSAQSRQQASMEKEQWNDTRSLRQKVNKRAEKEWDKADVAFDAQDNCQKSANVNAYWEPNTLRCLDRRTGRAINP

SEQ ID NO: 13815 - protein, 498 aa, Klebsiella pneumoniae
FTAQIRQRLPSTVARKTGGRQAARREKPFAFPDGGLVAHADGFGFAPAVEPVRAEIAAGTRLLHAAERQVGVNQGMAVDPYRSRLQTVGVVQGLGQIAGPDAGGQTKIAVVGQAQRLLAIGHSHQVHHRAKNLLTAETQSGVGVYHQRWRNIVPSRIWSGAAADKLCLLLASLFEVGRHLVAVGPGDHRVDLRRLLHPRPHLQRFHRLLEAADQGVKQRRFDVDPRAGGADLPLIEEASGHQPLNNPLGVGVFEHNRRILATQLQRHAGQAVGSHAGNLFPGRRRAGKANLRHLRMGGQRRAAAGAAAGDHVEHPVRNARLGRQLRHPQQGQRGGFRGFDDDRTARRQGRHDLPHADHQREIPRDDARHHPDRLFFGPRLVTRPLRERDRNVQRPAADLGGQPRGVAHPVQGAADLKGAGDGNGFPLLEGFQLRQLFAVLLHQIGKTQQDAFTVSRGAPGPAAIDKSAPGGHHRPVDIRRAGVGGGGNRLPGGRIPDG

SEQ ID NO: 13816 - protein, 109 aa, Klebsiella pneumoniae
YPAQELRAVAQSIINKNELVLNFIVNHLFCFFSSYFPFCNSFICTIYIFSYFQNNAVIIRFPNFALIHNFENFRLKTNYKKTTCINTVICIFCHFLRVSYFWWFFLHTG

SEQ ID NO: 13817 - protein, 81 aa, Klebsiella pneumoniae
QLNQLLRRKLRRRKSITKLRLNRQPRKRRQRKNTTKPLNTRPLNRLHSRQHNSSRRTNLLNNRRCFSAVFSGEHYAAALSF

SEQ ID NO: 13818 - protein, 247 aa, Klebsiella pneumoniae
SSLQYHEVRNMTAFHNKSVLVLGGSRGIGAAIVRRFVADGASVVFSYSGSPEAAERLAAETGSTAVQADSADRDAVISLVRDSGPLDVLVVNAGIALFGDALEQDSDAIDRLFRINIHAPYHASVEAARRMPEGGRIIVIGSVNGDRMPVPGMAAYALSKSALQGLARGLARDFGPRGITVNVVQPGPIDTDANPENGPMKELMHSFMAIKRHGRPEEVAGMVAWLAGPEASFVTGAMHTIDGAFGA

SEQ ID NO: 13819 - protein, 96 aa, Klebsiella pneumoniae
PGVQEKNSAGMKKKPPKIGNPQKVTENAYNCIDTGGFFIVCFKSKVLKIMDEGKIGKSDDDSIILKVTKNINGADKGIAERKIATKKAKEMIDDEV

SEQ ID NO: 13820 - protein, 514 aa, Klebsiella pneumoniae
ISSQNCVNVLPNSGLSARYLTKKSPVKYKCTTGVAMTAPVQHPMYIDGQFVSGRGDGWIDVLNPATEALLSRIPDGTAKEARLAIDAAERAQPGWEALPAIERAGWLRKIAAGIRQRADEIAGLIVAEGGKIQQLAAVEVAFTADYLDYMAEWARRYEGEIVQSDRPGENILVFKRALGVTTGILPWNFPFFLIARKLAPALITGNTIVIKPSEFTPNNAIAFAEIVHQVGLPKGVFNLVLGRGETVGQELAGNPKVAMVSMTGSVAAGEKIMAAAAKNITKVCLELGGKAPAIVMDDADLELAVKAVVDSRVINSGQVCNCVERVYVQQGIYDRFVNRLGEAMKAVQFGDPATRDDIAMGPLINAAARDQVAGKVAKAVAQGARVALGGQPLEGKGYFYPPTLLLDVRQEMDIIHEETFGPVLPVVAFSTLDEALAMANDSDYGLTSSIYTRDLNVAMKAIKGLKFGETYINRENFEAMQGFHAGWRKSGIGGADGRHGLNEYLQTQVVYLQA

SEQ ID NO: 13821 - protein, 76 aa, Klebsiella pneumoniae
SASQTLRRNRYSDANDRPPRLIDAHSLASHTNLHQDKQNDLSNQEVINECRTNDGAGLEPSPNGKTAAAGRGEHAR

SEQ ID NO: 13822 - protein, 107 aa, Klebsiella pneumoniae
NNGLLTWKERGIWAGENTVLQLFYTVSQTSRWRWLCADVLRKRKAGRNTWRISWKRPNEILPGTRRLSGAITSRPGQKFYSSMNAMSNSISMPFTGAMRQDGGINRR

SEQ ID NO: 13823 - protein, 117 aa, Klebsiella pneumoniae
AVQQGRREKCAGRAEIRLSTEQYFAASGYQLIDALLYVLTLFAINQGPHLNALLRRVTDGYFMQAGDQCIANRINLSQWHNDSADSGTFLPGFRRHLADHFPNKQREFRLLRRDVFT

SEQ ID NO: 13824 - protein, 115 aa, Klebsiella pneumoniae; identical to SEQ ID NO: 9318

SEQ ID NO: 13825 - protein, 437 aa, Klebsiella pneumoniae
AMPQLDEYLRQLAPSMTQWRRDFHLHAESGWLEFRTASKVADILDGLGYQLALGRDVIDADSRMGLPDEETLARAFERAREQGAPERWLPAFEGGFAGVVATLDTGRPGPTLAFRVDMDALDLNEQHDDSHRPHRDHFASCNAGMMHACGHDGHTAIGLGLAHVLKQYAAQLNGVIKLIFQPAEEGTRGARAMVAAGVVDDVDYFTAIHIGTGVPAGTVVCGGDNFMATTKFDVQFSGVAAHAGGKPEDGRNALLAAAQAALGLHAIPPHSAGASRVNVGVMQAGTGRNVVPSSALLKVETRGESEAINQYVFERAQHVVAGAAAMYEARYELRMMGAATASAPSPAWVDYLREQAARVPGVQQAVDRIAAPAGSEDATLMMARVQARGGLASYMIFGTELSAGHHNEKFDFDESVMALRVETLARVALNFPWQRGV

SEQ ID NO: 13826 - protein, 485 aa, Klebsiella pneumoniae
SFKQVSFVAMTHFSSKEKVMTTHRSEKDSMGAIEVPADKLWGAQTQRSLEHFRISTEKMPGELIYALALTKRAAAKVNQDLGLLTAEKAGAIVAAADEVLAGKHAQEFPLAIWQTGSGTQSNMNMNEVLANRASELLGGERGMARKIHPNDDVNKSQSSNDVFPTAMHVAALIALREKVIPSLQALRATLNEKAVAFRDIVKIGRTHLQDATPLTLGQEISGWVAMLDHSLKHIEASQPHLAELALGGTAVGTGLNTHPEYAVRVAAELASLSGQPFVTAPNKFEALATVDALVHAHGALKGLAASLMKIANDVRWLASGPRCGIGEIAIPENEPGSSIMPGKVNPTQCEALTMVCCQVMGNDVAVNIGGASGNFELNVYRPMVIHNFLQSVRLLADGMASFNEHCAVGIEPNRERISQLLNESLMLVTALNTHIGYDKAAEIAKKAHHEGLTLKASALALGYLTEAEFDSWVRPEEMVGSLAIR

SEQ ID NO: 13827 - protein, 69 aa, Klebsiella pneumoniae
PPEHKGKKTFRSPPSHRLRGEGMKRDTGRHMSARLLFYDQIINLASPRKIAKDGNIRASTVPVPVLREP

SEQ ID NO: 13828 - protein, 198 aa, Klebsiella pneumoniae
AKEQRFLQSAISKGYNMLIGYARVSTGDQNLDLQKNALIRAECELVFEDMASGKNARRPGLKRALRRLRAGDVLVVWKLDRLGRSVRDLITLVSELQARGVNFRSLTDSIDTSTPAGRFFFHVMSALAEMERELIVERTRAGLAAAREQGRVGGRRRVMTEDVVEQCRRMLENGATRQQVADVTGVDVKTIYKYLPAT

SEQ ID NO: 13829 - protein, 369 aa, Klebsiella pneumoniae
QSEHRSIYSERCSVKYNAFPYEEKAMSTQMMKAVQQHAFGGPEVLSYEDAPMPVLQAGEVLVQVHAVGVNPPDSYLRDGYQQLPPEWRPEVRFPLILGTDLSGVVVARADDVREVAVGDEVYAMARFPEGAAGGSRAYAEYVSVPVSDLARKPLTLSHQQAAVVPMSLLTAWQFMIDPGHEVANPLQPGPHRPVPLAGKRVLVNGAAGGVGHFAVQLAKWQGAEVIAVAAGRHEAFLRQLGADSVIDYTTTAVEETVRDLDLVIDAPGGPASGRFLRTLRPGGALYPIFPLGFAGAEEARQRGVTVSTTQVRSSGAQLARLADLLDAGIIRVAIDSVFPLAQAQMAHERAAQGHLEGKIVLSVMDSSAG

SEQ ID NO: 13830 - protein, 439 aa, Klebsiella pneumoniae
QRGHQPVFAPVAEADAKKLLRARRDELSGAKHRRMQVFHQRLQVGHQRLRPRRRQHASGAADEQRVVKHLAQPFQRPADSRLAKMEHLCGAGDAPFAVQHHQDCQQIQIDTTKIIFNDFVHYDNQFECGLSRQHSEYHPDKSTSAMRAEGVMQTYQTGDSLIFKVPEREISLQPAALYPEAFPVAEAEAVIQPIALSIHSWVVQTPYDLIVIDTATGNGRERGGNPLYHQLNTPYLENLRAAGVNPEDVTLVLLTHLHTDHVGWNTVWQDDRWVPLFPNARYLCSAKELSRVKNSERYRALWLDSLLPVIEAGQLETVDVATRPWVGGRIDFIPTPGHSPDHAALVLAAGDDYACFSGDLLHSPIQFAHPQWNSAFCGDPRQAEVSRREMMAWGASHHAQWFTGHFAGPSCGWLEKDKQGDYRWREAGKQAADKGNSDE

SEQ ID NO: 13831 - protein, 172 aa, Klebsiella pneumoniae
MVNKLWILLSGIIMVAMPSAQAGELSLYSMNTGSYVYHMTGNHGQYNEHFNNNFFSVERKFSQDSKYSVLVGTMKNSFDDRCLTLGVRRDWLKNDTGWVLKGVYAYTGEFFFDAFSHCGDSGTYRTAKKITGIGFSPYLYHGLQYNFTDYFGVEGGIIVPAIFVMSVQWSFR

SEQ ID NO: 13832 - protein, 156 aa, Klebsiella pneumoniae
NANKLFSEWFLPLSAKAAHSDTIRIEMELLVRLGHFFEQARSDADYATFANELRRHQVSYYIYFVSTGNMNFVMANDEVVSVKSARGLLRVRAEASHCLTRAAVIRHFARAINFEQYCRDLASAGVFKWIVDLEEETRHYWSKDNTLLYKECLMPP

SEQ ID NO: 13833 - protein, 410 aa, Klebsiella pneumoniae
PSCNMRKLMPYTLKHLPERYPRPKPLKFSRWLVALVVMLSVSIIIMRIFGRYVENLYFWRLALGFPVALWSVLLSSRLLVWSLQDSKANAFDKQREQWILRETRKARRALQVLSATFITGHSSVAQKDTAIAMQNNDSIIVSQVGRDGNESARMSQISSSPQDSMEFVIMNIFSQMIADIPFTQIPDKCPLVVVFDVTTSLPLENIRHYWDEAWQKNNITFPVEHVEGRGLSVIDRWLNERIKDKAMLLIVGLQIDPVVTNNTAEAAVALLLGNRLTQEALDPLALLHRPDAAPSGELSEGMRMAAWNVPLKESMVKNLWLAGMTGEQRAEAIGCQNAHPAQCVKDEAVISLDISMGNAGAAAPWLAIAAATEIARQTQSPQMIICGDTTQKVLWSTLITPIASRQEMDL

SEQ ID NO: 13834 - protein, 438 aa, Klebsiella pneumoniae
IRGNVMKKLFVQFYLLLFVCFLVMTMLVGLVYKFTAERAGRQSLDDLMKSSLYLMRSELREIPPRDWSKTLKELDLNLSFDLHIEPISKFKLSESSMQHLRAGDIVALDDQYTFIQRIPRSHYVLSVGPVPYLYFLHEMRLLDVALMAFIAISLAFPVFIWMRPHWQDMLRIETAAQRFGEGHLSERIHFDSMSSFERLGVAFNQMADNINALIASKKQLIDGIAHELRTPLVRLRYRLEMSENLTEAESQALNRDIGQLEALIEELLTYARLDRPQTELSLTTPDFPAWISDHVEDIQMVNPQREVALATLTHGNYGALDMRLMERVLDNLVNNALRYSSQRVAVSLTLQGSRASLLVEDDGPGIAPEERERVFEPFVRLDPSRDRATGGCGLGLAIVHSIAQAMGGEVRCEASPLGGARFCFSWPVYHQLPDFTSA

SEQ ID NO: 13835 - protein, 315 aa, Klebsiella pneumoniae
PTFKLIIIMNKIIENDFSRIDLNLLTVLMVLYREGSVTRTAEVLHLGQPAISGALKRLREMFDDPLFVRSARGMLPTPRAQALMTDLQPLMENLHSAMFGAGEFVPARAQQLFRIGLSDWSEHWLMPPLLPGLMQEAPGVSLQSIAADPFQVRQLLEEERIDVAVSVNKQSRGEVVSEPVMSMGVTTLWSPQQIPCRGPLSVSDFVAWEHVMVAYRETGHGEIDRQLASQGLARRVRFATQNFSTFPLLLTTLPLFATVPQGLAQRWQAQYALRADAPPVAYPEFTLCILRHKRRAQDPALNWLVAKLKQAMRGQ

SEQ ID NO: 13836 - protein, 153 aa, Klebsiella pneumoniae
AGAKRTAISTSEIFLFTSRVNGNGLYSQAGEGIMFYWILLALAIIAEITGTLSMKWASVSGGHTGFILMLAMIALSYIFLAFAVKKIALGVAYALWEGIGILLITLFSVLLFDESLSLLKIAGLTTLVIGIVLIKSGTQKKASSKQEVAHAAV

SEQ ID NO: 13837 - protein, 228 aa, Klebsiella pneumoniae
LPHNAPEEPDMQKLTRDEMAQRVARDIPEGAYVNLGIGLPTRIANYLPADKEVFLHSENGLLGMGPKPLPGEEDPELINAGKEYVTLLQGGCYFHHGDSFAMMRGGHLDICVLGAYQVSASGDLANWSTGAPDAIPAVGGAMDLAIGARQVFVMMDHLTRDGECKLVAQCSYPLTGVGCVSRIYTDLAVIDITDRGPVVREIFNGLSFEELQRITPVALTFQQLAESA

SEQ ID NO: 13838 - protein, 413 aa, Klebsiella pneumoniae
PFNNWRKARKEPMMNQAFICDAVRTPFGRFGGALATMRADDLAALPLKALLARNPGLDPLRIDDVIFGCANQAGEDNRNVARMALLLAGLPESVPGSTINRLCGSSLDAIGVAARAIKSGETQLMIAGGVESMSRAPFVMGKAESAFSRSMQMEDTTIGWRFINPQMKALYGVHSMPETAENVADEFAISRADQDAFALRSQLRTAAAQEAGRFADELIAVQVPQRKGEPLLFSRDEHPRSTSLEALAKLRGVVRADGSVTAGNASGVNDGACALLLASETALSANDLQPLARVVGVATAGVAPRIMGFGPAPAVRKVLAQTGLTLGQMDVIELNEAFAAQALAVTRDLGLPDDAAHVNPNGGAIALGHPLGASGGRLAMTAAYQLKRTGGRYALCTMCIGVGQGIALIIERV

SEQ ID NO: 13839 - protein, 811 aa, Klebsiella pneumoniae
MAGKSLGTLTIDLIAKVGGFVQGMDKAERSSQKWRDQVKKDAKEVSSSIIAVGAAAATAAVGIGAAGLAIVKNTAQQVTEADRWAKSLKMSTQDLLSWQYAAEQAGLTGDNIADIFKDINDKVGDAVLNKSGEAAQALDTLGLSAQKLAQQSPDKQLMAISEALQKIPTQAGKTNILESLGNDLSKMLPLFDNNNEKLKQFIQLSKDFGVAPPQEDIDNLVKVNQFFQDIETSARGLKMEIASGLAKVDLTPLQDGLDDIRDVFTDPAVLQGLSDLVGEAISLAGVVGRIAGGLGAIATYTRSRIGAVSGNYNAADESDIAQRIDFLNKRGNQSKEQKDELDFLTKRLQFLRAIKSSMTPEQVDRGAKGLTSLLSDLGIDTSKDNDFSLGNGESNQNQPKIKPKSNPTDNAFKSRLLDLQKQAALIETTGKKTAEVTELEKINFDITSGNLEKLSEGQKEQLRTAAKILDSKKEELRLNQENAKVAEYVSDLERQNKLVRQGFDNQIVGRYSGSRERSRMQDNNDIQQDFASRKEELLNQFQSGDIDKSLYDKKKEALQNSLNERLRIQEEHYKKLDELQSDGVAGFVSGISDQAAAYSNLYANMQQVGAQTFSSLTDMVINWAETGKLNAQDFAATFIQSVGAALLQYAAAQVAMAALSAFTAWIGVPYVGPVVASTQAIAAAAAAGVFMTAIGSALHGQAHDGIDSVPETGTWLLQKGERVTTAKTSAKLDATLDRVANQSTGGGAIYSPNINIPINGNPSDATVALVRKAAAEGAERGYRKAVNSVTTGQGDLHRALMVKTNSGRKIR

SEQ ID NO: 13840 - protein, 513 aa, Klebsiella pneumoniae
CRGKAIISLFTCHGPNATMTENTPYQQLTRTFQRLSRFSHLAAIAGWDMFAMMPPGGSVARSEALAELGVLQHQILTDKKVGQWLQEARQQDLNDVEQANLREMQRQYDQAALLPESLVEAKSLAGSRCEHAWRSQRPANDWTGFADNLREVVRLSRQEAQIRADARGGSRYDALLDIFEPDMTSARLDSLFADLKSWLPSLLSQAVEKQAKQTLIAPQGPFPIAEPRELGLQAMRILGFDFDGGRLDISAHPFCGGVPQDVRITTRYNENDLLSALFGVIHETGHARYEQNLPRPWVDQPVGLARSTAIHESQSLFFEMQLGRSERFLNRLLPAVRERFGDRPAFSQDNFVAWNQQVKPGFIRVDADEVSYPAHVILRYEIERALIDGEIEVDDIPSLWDEKMQHWLGLSTTGNYRDGCMQDIHWTDGGFGYFPSYTLGAMYAAQLMAAARRALPTLDRDIEEGDFSALFDWLRQNIWQHGSRFTTSQLIQQATGEDLNSRYFREHLTTRYL

SEQ ID NO: 13841 - protein, 528 aa, Klebsiella pneumoniae
VRGKSVNGLTGKMLMSVTTENAPVQGQTTLQENRAGEGVYASLFEKINLTPASRLGDINDFLDDAALSEAPAAERLTAAMQVFMERIRQSGQRVEKLDKTLIDHHIAELDFQISRQLDAVMHHQEFQQVESLWRGLKQLVDNTDYRQNVKTEILDVAKDDLRQDFEDAPELIQSGLYWHTYTAEYDTPGGEPIGSVISAYEFDASPQDVALLRNISRVSAAAHMPFIGAVGPAFFLKETMEEVAAIKDIGNYFDRAEYIRWKAFRETDDARYIGLVMPRVLGRLPYGPDTVPVRSFNYVEQVKGPDHEKYLWTSAAFSFASNMVKSFVNNGWCVQIRGPQAGGAVKDLPIHLYDLGTGNQVKIPSEVMIPETREFEFASLGFIPLSYYKNRDYACFFSANSAQKPALYDTADATANSRINARLPYIFLLSRIAHYLKMIQRENIGTTKDRRLLELELNTWVRSLVTEMTDPGDELQASHPLRDASVVVEDIEDNPGFFRVKLYAVPHFQVEGMDVNLSLVSQMPKAKA

SEQ ID NO: 13842 - protein, 304 aa, Klebsiella pneumoniae
DVLNMNIELRHLRYFVAVAEELHFGRAAARLNISQPPLSQQIQILEQQTGARLFARTNRSVSLTAAGKQFLADSRQILAQVDEAAARAARLHHGETGELRIGFTSSAPFIKAVSETLSMFRQRLPDVHILTRETNTREQIVPLSEGALDLGLLRNTQLPDTLAWERVLREPLLAMVPANHPLARQPSVSLAALAREPFVFFDPHVGTGLYDDILGLLRRYGHTPKIAQEVGEAMTIIGLVAAGLGVSILPASFQRVQLSEMRWLPIDEQDAVSEMWLVWSKHHEQGALAKRFREALLSWKSEHN

SEQ ID NO: 13843 - protein, 547 aa, Klebsiella pneumoniae
NALNKRPVDTQKRKIKTKVTFVIKETTEQDAGVNVIFNNLQILIMKEKKTTIPPAGAVKPTTANKKPLLMMALPIIVAVLLLFVPVPEGLPPYAWHYFAIFVGVIVGLIFEPLPGAVIGITGVVVIALCSQWLLFSPDQMAAPGFKMAGASFKWAVSGFGNSTVWLIFGAFMFAAGYDKTQFGRRLALILVKYLGRRSLTLGYAITFADLLLAPFTPSNTARSGGTIYPIIANLPPLYGSKPNDPSARKIGSYLMWVAITAACITSSMFLSALAPNLLALALVKSIVGINISWGTWFIAFLPLGILLILAMPLLAYWFYPPEVKVNNEVPLWAARELEKLGKLSRNEILLLVFVCFALMMWIFAADWIEPALAALLVIVLMLWTGVLSWSDITNNKAAWNTFVWFATLVALADGLSSTGFIAWLGKEGGALMSGISPGMATIVLLLAFYLLHYLFASTTAHTTALLPAMLTIASTIPGMNMEVFVLLMVTSLGVMGIITPYGTGPSPIYYGSGYLPTKDYWRLGTIFGAIFLAALLLIGYPWMSMMF

SEQ ID NO: 13844 - protein, 119 aa, Klebsiella pneumoniae
PFSNTQLPDLPSEAVTMAKRMQDKESIAGMSWLVLLIIACWGGLVRYLIDVKQSKATWSLINALAQMVVSGFTGVIAGLVSIESGLSIYMILATSGISGAMGSVALTYFWERITGVKAP

SEQ ID NO: 13845 - protein, 426 aa, Klebsiella pneumoniae
STAKDCGPVPRQIAPHRRHNHGRRVMRDAFICDGIRTPIGRYGGALASVRADDLAAIPLRELLSRNPGLDPAAIDDVIFGCANQAGEDNRNVAHMATLLAGYPHTVPGTTINRLCGSGLDAIGFAARAIKAGDADLLIAGGVESMSRAPFVMGKASAPYQRQAELFDTTIGWRFVNPLMAQHFGTDSMPETAENVAELLNISRADQDAFAWRSQQRAAQAQRDGILAQEIVPVQIVGRKGAVSDVREDEHPRPETTLEQLAKLKAPFRQGGVITAGNASGVNDGAAALIIASEQQAAIQGLTPRARIVAMATAGVEPRLMGLGPVPAVRKVLERAGLNINDMDLIELNEAFAAQALGVLRQLGVPDDAAHVNPNGGAIALGHPLGMSGARLALSASLELQRRGGRYALCTMCIGVGQGIAMILERV

SEQ ID NO: 13846 - protein, 146 aa, Klebsiella pneumoniae
IPAKLKRPRCRSHLAASQLPASGRYVGITTSSRPTMPDFRAARARGPTARPQGSEVAGRYSLPSTRHGRAVQTSPSGCSSAPAAPARPPRRRVPRPVRNRGRRRAARLSPLHPVSPPATTGRDSSRCPPAPAAPAVRHTPSADAAG

SEQ ID NO: 13847 - protein, 147 aa, Klebsiella pneumoniae
SKQKAAFATADSSSARYTAAFRHRLKGDTMELASLVRDILRQRHVERLAQHREQDNEAEAEWEIARWRHRSGVVIQRRYELESAQQDSASCPECWIDWQVIDAAGQEVNPMRKQFYNLCQQSFWLAMQAGGEDETSDRIAQITDNHP

SEQ ID NO: 13848 - protein, 110 aa, Klebsiella pneumoniae; identical to SEQ ID NO: 8215

SEQ ID NO: 13849 - protein, 172 aa, Klebsiella pneumoniae
FGPLIFHIADRPRYRVPGKIVGGNGSVAGYLRRFRAGDILPHPFPGGFRRQDQRPTVMNIDKTAIGGGRHDQESFGMVPTFERSPTNRGHKNWLAILTLDKVWLLCISFLFPLKPAVGEADRPSVLPQRLEHPAGGCSLNPGINQRRFIPPSWRIAPVNGIEMELLIAFIEE

SEQ ID NO: 13850 - protein, 86 aa, Klebsiella pneumoniae
DQGNINQCANTFFRHKPSERRGNRVQAIIAGTTSLFTQRQGDGNNVFGEKMFRIENNYERRKEVRIPVKIWWVKVLFLGIMLTNQE

SEQ ID NO: 13851 - protein, 881 aa, Klebsiella pneumoniae
LPMKGKYKAAIALVLVLVLLPLTLLLTLTHWVPTLAGIWLPVGTRISLQESPRLTRSALLIPDLRYLVGDCEIARVTDARLSRPSRWRLHIGQLEINSACLSKLPASDPSPGSPRTLAEWQSMLPYSWLTIDNLRLSPWEKWQGRLVMSLTPAHKDIGFAGKELSLQARLRGQALTVSQFSARLTDDQPPVKLVGTFHLPLVPDGLPVDGQMQGTFEFPQTAEWIDAELEWQHNRGQLLVTPRGEVEPILDLPWEITPERITISDGRWRTRYEAYPLRGRVALSVGNWQQGTEQMIVSGRLNVLTEGHAGKGNAVLNIGPGKLSMDNSDLPLRLTGEAKLGEMILYAALPAQLSGPLISPQLAFHPGALLRSRGRVIDALNIDEIRWPLAGVKVTQQGVDGRLQAILRAHEQQMGDFTLHLDGQASDFLPDSGRWQWRYWGEGHFTPMQARWDVKGSGEWRDNAITLSSLSTGFDKLEYGTMRVSTPRLTLEQPIRWLRDAEHPRLTGALSLDAAKTTFSGGSYLPASTLKFALDGRDPTWFQFTGALHAEAIGPVRLSGRWDGERLRGQAWWPKQSLTVFQPLVPPDWKMNLREGSLYAQVAFSAAAGQGFEAGGHGVLKGGSAWMPDNQINGVDFVLPFRFSDGHWQLGIRRPVSLRIGEIVNQVTARNLTADLQGTWPWSEANPLQLSDVSVDLLGGKLTLLQLRMPQRDPALIRLQHISSSELTSAVKVKQFAMSGAVSGALPLWLENNQWIIHDGWLRNDGPMTLRLDKDTADALVADNVSAGAAINWLRYMEISRSWTQINLDNLGVLTLKASINGTSRVDGKSSTVHLNYAHEENIFDLWRSLRFGDNLQAWLEQNATLPVRRCTDGKTCKEPK

SEQ ID NO: 13852 - protein, 122 aa, Klebsiella pneumoniae
LKMNHYLRAFVISFFLTGCGNHLVFEPNKLPDGYIDQEYYVPITISGGTGPVVDLSYEIHPSNSGLKLVFSEKKYYTKYVYNNFTIEGKPQLQGIVTINIRGGVVASAGQYFEKQYEINIQK

SEQ ID NO: 13853 - protein, 256 aa, Klebsiella pneumoniae
LTMKFKTNSFLFMMLCATALNSWAGYYNTIDIDGVSIHLDKDKAGYANVHDDQLNTDYSCKIENWNDSLISGAGDISLTSDHLGVLLASGNKYLDVKELIDCKGQSIRIHSIHYFNNSISSIIDVNFEKKLVLALVVIDAHFRSYQAIVSKFNGNKNLLSGKGFWSNSSSEPDQNSLFYPGGSIYLGKISVNGEYIAPNDLDCAVDSFPGVWDIARKMKIIFPRDKDDAVIDSKCRQLFSGEKTLDELGGELINMK

SEQ ID NO: 13854 - protein, 285 aa, Klebsiella pneumoniae
SSVKAMNTLQSTNWLQYGIKDIKHLKHANMHDPLIPFEPVFSPQGPTLLVAVRQSEVIRETPRHHHSCGQLIGAIRGLLTVDGGDCRWVVPATHAVWIPPGVPHGLRSHGPYSGWSVYVSAKACGELPDKPSVLSMTNLLREAITRAAAWQGVELTASQKRLAGVILDEIGSLPRVNLGLPMPQDSRLLRIAQALSANPDDGCRLEEWAAWAGMSSRTLTRRFRAETGFSFNEWRQRIRLLRALELLAAGKPVTAIALDLGYDNVSAFIALFRRMFGTTPGRYKI

SEQ ID NO: 13855 - protein, 717 aa, Klebsiella pneumoniae
AMSNQESPGGVSRRALLKSTALGSLALAAGGLTLPFTLRRAAAAVQQATGDTTRIVWGACSVNCGSRCALRLHVRDDEVVYVETDNTGDDRYGDHQVRACLRGRSIRRRINHPDRLNYPMKRVGKRGEGKFVRISWQEALDTLADRLKSVVAQYGNEAVYINYSSGIVGGNITRSSPSASPVARLMNCYGGSLNQYGTYSTAQIACAMPYTYGSNDGNSTSDIENSKLVVMFGNNPAETRMSGGGITWYLEQARERSNARMIVIDPRYTDTAAGREDEWIPIRPGTDAALVAGIAWVLINEDLVDQPFLDKYCVGYDEKTLPAGAPANGHYKAYILGEGDDGIAKTPQWASRITGIPTDRIIKLAREIGMSKPAYICQGWGPQRQANGELTARAIAMLPILTGNVGINGGNSGARESTYTITIERLPVLENPVKTAISCFTWTDAIARGPEMTASRDGVRGKEKLDVPIKFLWNYAGNTIINQHSDINKTHEILQDESKCETIVVIDNFMTSSAKYADLLLPDLMTVEQEDIIPNDYAGNMGYLIFIQPATSAKFERKPIYWILSEVAKRLGDDVHQRFTEGRTQEQWLQYLYAKMVAKDPALPAYEDLKRMGIYKRKDPNGHFVAYRDFRHDPEAHPLKTPSGKIEIYSSRLAEIAARWQLEKDEVISPLPVYASTFEGWDDPLRSQYPLQLFGFHYKARTHSSYGNVDVLQAACR

SEQ ID NO: 13856 - protein, 294 aa, Klebsiella pneumoniae
RPAKSLLRSRKIAANSSTRRKAKSTVIRLSIPCRTAWNICEAAMNNPNPVATYALRLGDNGLVLAQRLGAWCGHAPELEIDLALANIGLDLLGQARNFLSYAAELNGCGDEDTLAFGRDERQYSNLLLVEQPNGNFADTIARQFFIDVWHVALFSRLVNSRDAQLAAIAAKGLKEVRYHQRFSRGWLERLGNGTELSNRKMQQAVDNLWRFTGELFLADEVELSLVEQGIAVDPRELQAEWQSAVHTALLDSGLQIPQEAAFRSGGKQGLHSEHLGPLLAEMQYLQRSHPGLQW

SEQ ID NO: 13857 - protein, 67 aa, Klebsiella pneumoniae
PLKNSRIGEDVTNVIKPILQWRKVNFSQPRSNFHFKTAGASLYILKELINLNKVINIFLRWCDTKIF

SEQ ID NO: 13858 - protein, 335 aa, Klebsiella pneumoniae
SLEKSLMKIAVYSTKQYDKKYLQHVNDAYGFELEFFDFLLTAKTAKTANGCEAVCIFVNDDGSRPVLEELKAHGVKYIALRCAGFNNVDLEAAKELGLRVVRVPAYSPEAVAEHAIGMMMSLNRRIHRAYQRTRDANFSLEGLTGFTMYGKTAGVIGTGKIGVAMLRILKGFGMRLLAFDPYPSAAALELGVEYVDLATLYKESDVISLHCPLTDENYHLLNREAFDQMKDGVMVINTSRGALIDSQAAIDALKHQKIGALGLDVYENERDLFFEDKSNDVIQDDVFRRLSACHNVLFTGHQAFLTAEALISISETTLGNLQQVANGETCPNAIV

SEQ ID NO: 13859 - protein, 287 aa, Klebsiella pneumoniae
CCRKLSKKVLRPAQKRQAVHFLREAYRISVRRGCGLLMQSRTVYHWQSRRDDRAITLRIREIAETRIRYGCPRIHIQLRREGWPVNHKKTHRIYCLEGLNLRKKRPRRHVSAAHRQQRPVLSGVDQCWNMDFVSDNPFNGRRFRALTVVDNFSRECVAIHAGKSLKGEDVVGVMERLRVLGKRLPVRIQTDNGSEFISKSLDKWAYEHGVTMDFSRSGKPTDNPFIESLNGSLRDECLNIHWFLSLEDAQDKLDNWRREYNHERTHSSLNDMTPAEFIRNLRKDEDL

SEQ ID NO: 13860 - protein, 89 aa, Klebsiella pneumoniae
QTADPAIFAFVSSMRRVPVTRSIFCVVRGENGCLPGEEPPAPGDMAEADQALGENLLENVNEAHKYVLPLSTPPATLPIILGFAFLRRF

SEQ ID NO: 13861 - protein, 409 aa, Klebsiella pneumoniae
MLYDAGKDSRLNIEGLMMAVYKLSTRIRSNVPTDSLLYDLCIYRMDSRRNKYSLIDVKQQPFSGTFETQTHMTGNVDESLSTIYIMEMNLYRKTMLHTVCVTPVPFTKMYTLEAFASGNAWSSEKRENLCYFETKGTMKPASEGGETKEIRITIPERPFIAREYPIGSPQDPFKKKKIESEIQNRFYNLSYPSQSGASVCGPAAFFYCLQQDRPDVYAQAARELWRYGKTKIGALTISPGEGCRHPTGMFFTSDGQPRILGLDWITLAGLRDSENAALSFDALDSPVAGITMWPTLAEWFEKAGYEMVFSNVGITQAGVQGIRDLNRYVAQGFKVVTLINDGLLEGSTNNTTLPTHWVVWDSSVTQDDNGYVNLKLFSWGRSTYWIKKGKDVRFFLNRFFGGMVFKPLK

SEQ ID NO: 13862 - protein, 311 aa, Klebsiella pneumoniae
WDNERRGGNEMDKLDAMQVYVAVVDTHSFARAAEVLGQPRSTVSRVVKELEAWLGTQLLQRTTRKLSVTAEGRRYYEECKRLLAEMAAMEASFPGRSAQPAGRFKVGMPQSLARHCILPRIGEFLQQYPDLELILCSSDNVEDIIQEGFDCVIRTGRIEDSTTLVARPLARYRWMVLASPAWLAAHGRPQSIDELHQHRAVGYLNHRTGRTIDWLFSLDDGDCAIRMRETLVVDDTDAYIQAGIQGLGLIRVASYLAQPFLQSGALVACLEQAASDLPLSLVYPQNRYLPPAVRAFYDWSRRVLQSPLSEA

SEQ ID NO: 13863 - protein, 63 aa, Klebsiella pneumoniae
LADELCDTGVNMGPSVASKFFQRWLTALNMRGKLYPDLIPDGAIGPRTITALKGYLSARGERG

SEQ ID NO: 13864 - protein, 216 aa, Klebsiella pneumoniae
YCSDDYNMLRQNRLSRINIVTTTKQGRTPGRPRQFDAEQAIETAQRLFHARGYDAVSVADLTQAFGINPPSFYAAFGSKLGLYTRVLQRYSQTGAIPIDALLRDDQPVAASLIAVLQEAARRYVADPAAAGCLVLEGVHCQDADARVAAGEWHAAARAKIQQYIARHRPQDALRVTDYMDTLMLGLSAKAREGDSLPRLLETVRLAGLALERILPA

SEQ ID NO: 13865 - protein, 152 aa, Klebsiella pneumoniae
SSNDIDRRPMDNRQLTFSHLLYLTAHHWRLAVNRRLKNLGLSQASWVAVASIARHQQPLSQSELAQELGVESPTIVPLIHRLVALGLVERITTASDKRKRLLVVTDKGKALYEQVKTVADDLREEILTAITPQEQEQTQRVLEKLLREVEKK

SEQ ID NO: 13866 - protein, 188 aa, Klebsiella pneumoniae
LDNDQITNNPKLTRLVRVFLLWRQNMSVLTQGTQFFVLKSGVVSEVECITSFNPGGNPADQIEDTCLSERDSRTYKKGLKTPAAATVGLNADPTNASHIMLHGLAEANDQTPLTFAVGWSDGTSVPTAAAPGAEDAVDGLVLPSDRTWFIFQGYVSDFPFDFQGNAVVTTSATIQRSGSSVWVPKAAA

SEQ ID NO: 13867 - protein, 66 aa, Klebsiella pneumoniae
PMNEQLVNAMIAALREQTAAQREQTEAINRLAESNVALSDVIIQSLAGDLEEAPEQQTYLSGKPRG

SEQ ID NO: 13868 - protein, 585 aa, Klebsiella pneumoniae
FMDDLTLRYYDAEMRYLLEAGEEFARAHPEQAAMLNLDKAGARDPFVERLFEGFAFLMGRMREKLDDDLPELTEGVVSLLWPHYLRTIPSMSVVEFTPDWPEMKEPMTMAKGFEVLSRPIGEKGTRCRYTTTKAIALQPLSLERVQLATDTDGRSVITLRFTCSQLTDWRRVDLSHIPLYCNADAPLACAMHEAFTLNVARMWLRMPDEVDRRPLDGYFSALGFGEDDGLWPEDGRSFRGYQLLLEYFTFREKFMFIDLRGLETVAFPAGLAWFEIDVVLAERWEHDFRFSEKQLRLHCVPVINLFPLESDPLTINSLQTEYPLRPMRVQDGHTEIYTVDSVISSHQQVYAPFSSFRHKGGMMRHDAADYYYHTRVRRGPSGLYNTWLIVGGEAFDNHTVPEDESLSLTLTGTNGQLPRRALQSTVLDTVMKTTSASIAVRNLCAPTLPCYPPAQDRFHWRVLSHLGSSFLSLMDNAEVLRGTLALYEWTDSEMNRRRLEAILDVKHRATERFAQGHLVRGVKIEVTLDSHGFAGRGDICLFGEMLSRFFALYTDIYLFNRLIIILQPTGERLEWEEKHSRRIPG

SEQ ID NO: 13869 - protein, 445 aa, Klebsiella pneumoniae
FTCEYPTMITTTKLDPIETASRDELQALQTQRLKWTLKHAYENVPMYRRKFDAAGVHPDDFRELNDLQKFPCTTKQDLRDNYPFDTFAVPMEQVVRIHASSGTTGKPTVVGYTQNDIDNWANIVARSLRAAGGSAKDKIHVAYGYGLFTGGLGAHYGAERLGATVIPMSGGQTEKQAQLIRDFQPDMIMVTPSYCLNLIEELERQMGGDARGCSLRVGVFGAEPWTLAMRAEIERRLGITALDIYGLSEVMGPGVAMECLETVDGPTIWEDHFFPEIVNPDDGTPLEDGEHGELLFTTLTKEALPVIRYRTRDLTRLLPGTARTMRRMDRISGRSDDMLIIRGVNVFPSQLEEEILKFEHLAPHYQLEVNRRGHLDSLAVRVELKNNGLALSHEQRCQICHQLRHRIKSMVGISTDITIVNCGSIPRSEGKACRVFDLRKAVVSG

SEQ ID NO: 13870 - protein, 243 aa, Klebsiella pneumoniae
CAIDMNKIVFVEDDPEVGTLIAAYLGKHDMDVVVEPRGDRAEEVIAREKPDLVLLDIMLPGKDGMTLCRDLRGQWQGPIVLLTSLDSDMNHILSLEMGASDYILKTTPPAVLLARLRLHLRQHIAPAGAGSASSTLTPHKTISFGSLTIDPVNRQVLLGGENVALSTADFDLLWELATHAGQIMDRDALLKNLRGVTYDGMDRSVDVAISRLRKKLLDNATEPYRIKTVRNKGYLFAPHAWDN

SEQ ID NO: 13871 - protein, 82 aa, Klebsiella pneumoniae
DMSEITASEQIRLDIIKKVNYDTAAAKLAIDWVGDSYLKSELFADSFDRVFTESEIVSKTRKAIQEATEALALFDTIAEQAS

SEQ ID NO: 13872 - protein, 186 aa, Klebsiella pneumoniae
FAGLRLFIQQLHQEVASEVGGHQYHCVAKVDFTPLAVAHYPPVEDLVEQVHHIAMGLFHLIEQHHAVGAFAHRLGQDPALAVADVAGRRTLQLADGVRLLVLGEIDGDQRFLAAEQRIGQGERRFRFAGAARPDQQEHPLRTVLRRQAGFRGAQAPGNSAQGRLLANHPFAETLFQTQQLRLLIFH

SEQ ID NO: 13873 - protein, 157 aa, Klebsiella pneumoniae
CSPEKTALKQRRLLRRLVRREELCCRLCSRFSGLVFSGFVVFFRCLRFLGCRFSRSFVMLFRRLSFLRSSWFSCYFFVFFSGLGFLSSGWFSFCFFVFFGSLSFLLCGRFCRGFVVFFVMGGLGSRAVGGSRCLSGAYCVSSESGGRETHSSGNDQS

SEQ ID NO: 13874 - protein, 420 aa, Klebsiella pneumoniae
TLKDHHILRFPHLEHRHAGDRALRIVLRRRVDGIVGADHQHGVGVAEIVVDLIHLQHDVVRHFGFRQQDVHMPREAPGHRMNTKAYFDTPRPQLLGNFCYRILRLSHRHTVARGDDHRVRVFQHLRRLFGTNLAMLAHFFIAAAGGTIGAEAPGDHADKGAVHRLTHNVREDGAGRAHQRAGDDQQVITQHKARRRCRPARVGVEHRDHHRHVRTADRGHQVPAKGQRDRGHHQQAQDLGAGAVRANKNHHQDEGNHQRRQVQLMAIGQHQRPGGNFAAQFTKRHHRTGEGHRADEDPEEHFGQMNIDQNLLHTGFMLQVAVETHQHRCQPHEAVQDSHQLRHLGHLDLLRQTNTDRPADHHRKNNPADVAGVRPQDGSNQGNGHPGDAEIVALLRRFVFRQARQAENKQDCSNNVCSRY

SEQ ID NO: 13875 - protein, 539 aa, Klebsiella pneumoniae
TAKDGEEDFAVLALLGRKVNHHQKPMEGKTMRIGVPQERLAQETRAAATPKTVEQLLKLGFSVAVESGAGKLASFDDEAFAEAGAEIVTGEEVWQSDVILKVNAPNDDEIALLNPGTTLISFIWPAQNPQLMEKLAARNINVMAMDSVPRISRAQSLDALSSMANIAGYRAIVEAAHEFGRFFTGQITAAGKVPPAKVMVIGAGVAGLAAIGAANSLGAIVRAFDTRPEVKEQVQSMGAEFLELDFKEEAGSGDGYAKVMSEAFIKAEMALFAAQAKEVDIIVTTALIPGKPAPKLITREMVDSMKSGSVVVDLASQNGGNCEYTIPGEVVTTANGVKIIGYTDLPGRLPTQSSQLYGTNLVNLLKLLCKEKDGNIVIDFDDVVVRGVTVVREGEITWPAPPIQVSAQPQAAAKKVEAPKEAVKPASPWRKYALMALAIILFGWLANVAPKEFLGHFTVFALACVVGYYVVWNVSHALHTPLMSVTNAISGIIVVGALLQIGHGGWVSFLSFIAVLIASINIFGGFTVTQRMLKMFRKG

SEQ ID NO: 13876 - protein, 135 aa, Klebsiella pneumoniae
RSEEIPPGRYLTGWTGSRDAPLAPMIYPTTKPQTLHRIQAQYAAKASSERVDQLFAALAAALKAKGFTRFIVAGGETSSIVAQTLGVEAFHIGPTISPGVPWVRDTRQPLSLALKSGNFGDIQFFARAQQEFRHD

SEQ ID NO: 13877 - protein, 171 aa, Klebsiella pneumoniae
LAGEAVSLIISLIESAQDHYPWVLLIVFLLTFTKSCALVSLAIPGTSGLLLLGTFASASLGHFLLMWSSASLGAIGGFWLSWRLGIRYRHRLTHLRWLTAERLARSRLFFQRYGPWAIFFSRFLSPLRATLPFVSGASSLPLWSFQLANVSSGLLWPLLLLAPGAFSLSLW

SEQ ID NO: 13878 - protein, 170 aa, Klebsiella pneumoniae
DRLDVPGGGGPGSLLVGWAGQRHRLNAARLVLGRYRRPARHPLAESQPAERLRSLWRTTGHLSTAADRPAAGDRLGETFFPPPGGGPDREGERMKNIIPDYRLDMVGEPCPYPAVATLEAMPSLQKGEILEVVSDCPQSINNIPLDARNHGYTVLDIQQDGPTIRYLIQK

SEQ ID NO: 13879 - protein, 66 aa, Klebsiella pneumoniae
THTEITIRKREIPLSKANHHFDGHSRWIIRIKARHWLYDIIWIDTATAKHFADWVAKFRLVRFGWV

SEQ ID NO: 13880 - protein, 193 aa, Klebsiella pneumoniae
PVQERKMSERNPFFSVSTLPYQAPPFDVIDDSHYRPAFDEGVRQQRAEIRAIIDNPQPASFANTLEALEQSGQLLARVTRVFFAMAGAHTNPYIQSLDEQFSAELAELGNDIWLNAALFQRVNSVYEQRDALALDSESYRLLTLTWQRFVHAGGDAGSRAAGGAAHTEHRSGYAAKSVPAATAGSGKKRRPGG

SEQ ID NO: 13881 - protein, 320 aa, Klebsiella pneumoniae
FIKEKYNNRMNQMSKLDAFIQQAVTAMPISGTSLIASLYGDALLQRGGEVWLGSVAALLEGLGFGERFVRTALFRLNKEEWLDVVRIGRRSFYRLSDKGLRLTRRAEHKIYRASAPEWDGTWLLLLSEGLEKNVLADVKKQLLWQGFGALAPSLLASPSQKLADVQSLLHEAGVAENVICFEAHSPLALSRAALRSRVEECWHLTEQNEMYEAFIALFRPLLPLLRDCDPSELTPDRCFQIQLLLIHFYRRVVLKDPLLPEELLPAHWAGQTARQLCINIYQRVSPGALAFVSEKGESSVGELPAPGPLYYQRFGGLPGA

SEQ ID NO: 13882 - protein, 260 aa, Klebsiella pneumoniae
RAGDSMSDLLIHRHGRALQLTLNRPQASNALNNALLTQIAEALEAAAVDDSVGVCVIRGNARFFAAGADLNEMAEKDLPATLDDIRPRLWGRIDAFTKPLIASVNGYALGAGCELALLCDLIVAGDNARFGLPEITLGIMPGAGGTQRLIRSVGKALASRMVLSGESIDARQAQQAGLVSDIHPAALTDEYALKLATTIARHSPLALRAAKQSLRLAQEVSLQAGLQQERQLFSLLSATEDRREGIDAFLQKRTPEFKGR

SEQ ID NO: 13883 - protein, 135 aa, Klebsiella pneumoniae
RPSLNSDITSHFFSKATKLFPVAIRQVVTDNGKEFLGNFDKTLQEASIKHIWTYPYTPKMNATCERFNRTLREQFIEFNELLLFEDLNLFNQRMAEYLVLYNSKRPHKSLELMTPVDYILRESKNCNMWWTHTEY

SEQ ID NO: 13884 - protein, 62 aa, Klebsiella pneumoniae
KKSLSIRRLTLLYPAPWRKAPLEISANWEEDRMQIDRNEKEVADAVDAATVLPDRRSACITR

SEQ ID NO: 13885 - protein, 148 aa, Klebsiella pneumoniae
TGGFMSRMILVPIDISDKEFTERIISHVESEARIDDAEVHFLTVIPSLPYYASLGMAYTAELPGMDELREGSETQLKEIAKQFSIPEDRMHFHVAEGSPKDKILALAKSLPADLVIIASHRPDITTYLLGSNAAAVVRHAECSVLVVR

SEQ ID NO: 13886 - protein, 402 aa, Klebsiella pneumoniae
NLLCLKQGLRMQKLINAVQNYAWGSHTALTELYGIANPDNLPMAELWMGAHPKSSSQILAADGQPRSLREVIDADKAALLGDKVAARFGELPFLFKVLCAAQPLSIQVHPNKQASEEGFARENAAGIPLSAAERNYKDPNHKPELVFALTPFLAMNAFREFSEIVTLLQPVASAHPAIGAFLQQPDATHLSQLFASLLNMQGEEKAKALQVLRDVLAREQGEPWQTIRLIAEFYPDDSGLFSPLLLNVVKLNPGEAMFLFAETPHAYLQGVALEVMANSDNVLRAGLTPKYIDIPELVANVKFEAKPAGKLLTQPQRHGAELDFPIPVEDFAFSLHDLSAEASDLAQASAAIVFCVDGEAVLRKGDQSLTLKPGESAFVAASESPVQVSGRGRVARVFNKLQ

SEQ ID NO: 13887 - protein, 130 aa, Klebsiella pneumoniae
PLIWHKLLKLLILHALILVSNILIRVTYSLYELLFQKYLLQARVLEEIAPERNLGWSLIKRGGVDPPLRRVNSNGVQQNQLSGLLEMLFHTIPRPINIDAKRANRVVEIKMLAMAVPQKVRMQIIRHGVG

SEQ ID NO: 13888 - protein, 150 aa, Klebsiella pneumoniae
YVRWAGGPGSCRGQRPPSRRAVCGAAALYRPAASTHESPSAGDRLRWRSRPCRSSPALRCGSPTAACWSRGKSGSPAPLYASPAARQNAVRRQYARPAAGATRDKTPRAPRRRPPGRRQPPRWPPATAATDPPGPVCSSLRRCLAATARL

SEQ ID NO: 13889 - protein, 78 aa, Klebsiella pneumoniae
RTSCSSVTVPPGELGWTLKTPSTPAIADRIAARSSKVPTTSSAPRAASAAAPAEKGSLTSARTRQPRCSSARATEPPC

SEQ ID NO: 13890 - protein, 336 aa, Klebsiella pneumoniae
PCSCRVGAFAARLAPSKESPMSDNRVYSYSAVLMGSPILLKLCSHDEAMASRVFQLIKRYEDLLTVNRAESQVMDINHAAGRHPVTVSRPVFQLIQCAKAASMVRDSAFNLAIGPLVKLWRIGFHGHSVPDAAEIRARLALTHPQEVILDEATCSVFLQQPGMELDLGAIAKGYIADRVRDFLRQQQVEKALINLGGNVHTLGEWAIGLKKPFADAQALIGSLTVNGQSVVTSGTYERYFEQDGKRWHHILDPRSGYPLDNELDSVTVISADSLDGDIWTTLLFGLGVEKGCAALRQRQDIDAIFVTKNRDIILSSPQRLRFAPLDSGYRVIDCTA

SEQ ID NO: 13891 - protein, 349 aa, Klebsiella pneumoniae
RRSCAWARSMIFSVKERQMEHLVNDLLHCRLQAWTFPAGIEARWLGEGILQLLPTAPWRQATILSAGVHGNETAPIELLLQLTHDLSQGRQPLTQALLIVFGNLPAIRAARRYLHNDLNRLFGGRHLAVTPGNESRRAFALEQAVQAFYRAADAAGPVNRGHLDMHTAIRGSLYRQFALLPAHAGDFSPDFYQLLQASGMDAVVRHTEAGGTFTHFTCEKFAAQSATLELGKVMPFGANDLSLFAAADAAIRAWIADAPLPPRDKAPVDYFLVEESIIKREGEFTLNLAADVENFTALPAGYEIARQAEKRWVVQARAPYILFPNAGVATGQRAGLLLRAAALRLPQPA

SEQ ID NO: 13892 - protein, 243 aa, Klebsiella pneumoniae
KETCVINVLIVDDDAMVAELNRLYVARVPGFRCSGSASTLSQAQEMINDPQQEIDLVLLDVYMQQDSGLDLLPTIRESGRAIDVIMITSAADAATVQTAMHYGVVDYLIKPFQFPRFEEALTTWREKRKLITGQPYYEQADVDRLLHGGAPEASDARKLPKGLTAQTLRTLCQWIDAHPDVEFSTDELAAAVNISRVSCRKYLIWLAQINILYTTIHYGATGRPVYRYRLVAEQYSLLKQYSQ

SEQ ID NO: 13893 - protein, 97 aa, Klebsiella pneumoniae; identical to SEQ ID NO: 8251

SEQ ID NO: 13894 - protein, 276 aa, Klebsiella pneumoniae
PRCWTRQRRPAAPNALCARCWRVIRSNVMNLDYQLDGPDDAPVIVLSNSLGTTRAMWQPQIEALTAHFRVLRYDTHGHGKTTKNGKVTLAQLGEDVIALLDHLNIDRAWFCGISMGGLTGLWLGRFASERFHGLAVANTAARIGDQASWLSRARAVRQEGMAVVAAGAADRWFTHAFRQKAPEVVEALCHQLTHTDAEGYAACCEALAAADLRGEVGQIPLPTLIIAGESDPVTTVGDAHFLQQQIPASEVVVLAASHLSNIEAPKSFTSALLSFF

SEQ ID NO: 13895 - protein, 219 aa, Klebsiella pneumoniae
TACWAWVRARVRTIFLRPLPPSWVPIRACSLPPFYKETDVLRISLTKTACLLPLLALCLSGCGLTQRVSEGTKSAFNAVFYKKINTLHLDFTAREALNTDARENHSLSEPVVVRIYQLKDRQTFDRLVYQQLLEEGDILLAADLLASRDVVIGPGGDASLNMPLEAEATFVAVVGLFRHPDTQRNTWKQVLAREELDPDKPRIFTAEHNQLRLRPEAAK

SEQ ID NO: 13896 - protein, 167 aa, Klebsiella pneumoniae
AFEWIFRRLIMALKTLSALPVFADSLFADRFNRIDRLFSQLTGDTPVGTLPAYDLQKVDDSNFLLSVSVPGWKDDELEIETVGGNLHISGKRQETDSSTDSGERWIYKGIRRANFQLSFSLPEHAQINQAQLDSGILKIAIHQEIPESEKPRKIAIENQGRVIEHKV

SEQ ID NO: 13897 - protein, 154 aa, Klebsiella pneumoniae
LCECFGVKMNKFAALLAAGMLLSGCVYNSKVSTGAEQLQHHRFVLTSVNGQAVNASDRPLELSFGEKMAITGKMYVSGNMCNGFSGEGKVSDGELKVKSLAMTRMLCHDAQLNTLDATIDKMLREGAQVDLTENQLTLATADQTLVYKLADLMH

SEQ ID NO: 13898 - protein, 65 aa, Klebsiella pneumoniae
  UNSURE (58),(62),(64): Identity of amino acid at the above locations are unknown.
VQMCLIEASCSVLSKLPRNSLPLSVTTCLIATGKSFVALLKKWLVISLLSEGLQRGSXGVIXGXQ

SEQ ID NO: 13899 - protein, 388 aa, Klebsiella pneumoniae
PLLRALHRYLLVQPPDYHSATNRRTTGMGREAQPPHSRLTPRLEADLPRINFYRFCQLLEKRRPGQPLMGGTSHPADDPVRFYPHPGMGFPASELKAVEYDEADDSRPPVIRTTFMGLYGVDSPLPTAYLDDIAQHREGHEALQGLLDIFSHRIMTQFYRIWRKYSWPATFEPGGTDRLSQSLLGLAGLGIPGTTQHIASPASRFLALTGVLRQPGKTQQGIQALVTLLAPETTVRVSPYSLRPVAISQPLGFYGDDDFFLDGNTPLGDEAMDASSQLLVALTTDNPAEAQGWKPDGPLFRDFLILLRVYLGWRFRANITLTAPTRLLAVPPLGDEPFWLGMNGVLGVGEGESEDDIPQTFTTELGTYTGLQPATFLQGNRRVTYKFD

SEQ ID NO: 13900 - protein, 140 aa, Klebsiella pneumoniae
SIHRFHRGLTIKMITITRVLDDIINHQQIPLDRILSRYFSPGYRQRTDNKWEGLDGFAQHARRLREIIAFAKIELHDELRNGNLYATRHRVLCTRRSGEEVDMEVYMFAEIDDSGRFIRIEEATLMLKGRESDRDLGSVR

SEQ ID NO: 13901 - protein, 432 aa, Klebsiella pneumoniae
LMHRLHPYPDVQVMFRRLLIATLIGLLAALAVALFRHAMVVLETLLLSNDSGSLVNAAQSLPAWRRLVTPALGGLTAGTLLWLWQRRSVARPHAATDYMEALETGDGCFDTPASLVKSLASLLVVVTGSAIGREGAMILLAALAASLFARRFTPQSEWKLWVACGAAAGMASAYHAPLAGSLFIAEILFGTLMLASLGPVVISAVIALLLTQFLNGGAAPLYHVVLQQNLSALHYGLMLATGLLAGLCGPLFIWLMDYSHRGFVKLKLAPPWQLALGGLIVGGLSLITPAVWGNGYSVVQSYLLLPPSGALLAGVFICKLLAVLASSGSGAPGGVFTPTLFVGLAMGMLFACFSRLWLPGSEEMAIMMGLTGMAAFLAATTHAPIMSTLMICEMTGQYMLLPGLLITCVVSSVLSRTLRRDSIYRHHVAEHV

SEQ ID NO: 13902 - protein, 150 aa, Klebsiella pneumoniae
LLNRCSDHYHQYHNNHWDRDMKKIAIMLFALLLTACAANPPSQVQLHSADYGVLPDNYQQQIKDWWGRMLKDPYSAHYTFGTPEKAWFKDGILAESGGAMRYGWLIPITINAKNSYGGYTGAEAHTIFYSHGKIDSADAQVNAGYTGKVK

SEQ ID NO: 13903 - protein, 92 aa, Klebsiella pneumoniae
RSGRLLTYRGTCQPFNFLQATKNPAEARFWFVYILVKLFNFSRIARIHLSISGVYFPMGVKNSMCFSTCISAIGVFSINGYRNKPSISHSPT

SEQ ID NO: 13904 - protein, 284 aa, Klebsiella pneumoniae; identical to SEQ ID NO: 8262

SEQ ID NO: 13905 - protein, 207 aa, Klebsiella pneumoniae
PAVLSGDAVLPFGSIVDCRQRVVSCASHVRWWMTETMLTLLQDKMDTPLGPLWVLCDEQFNLRAVEWDEHRDRMETLLDVHYRREGYQRVDCRNPGGLSSKLSDYFAGDLAIIETLPTATAGTPFQRQVWQALRDIPCGQVMHYGQLAEALGRPGAARAVGAANGANPVSIVVPCHRVIGRNGTMTGYAGGVQRKEWLLRHEGYLLL

SEQ ID NO: 13906 - protein, 535 aa, Klebsiella pneumoniae
IRNRAMTAKTAPKITLWEFFQQLGKTFMLPVALLSFCGIMLGIGSSLSSHDVLTLLPWLDMPLLQAIFIWMSKVGSFAFSFLPVMFCIAIPLGLARENKGVAAFAGFVGYAVMNLAVNFWLTAKGILPTTDAAILKANNIQNIIGIPSIDTGILGAVIAGIIVWLLHERFHNIRLPDALAFFGGTRFVPIVTTVVLGLVGLAIPLVWPVFAMGINALGKMINSAGDFGPMIFGTGERLLLPFGLHHILVALIRFTEAGGTLDVCGHSVSGALTIFQAQLSCPTTHGFAESATRFLSQGKMPAFLGGLPGAALAMYHCARPENRHKIKGLLISGVIACVVGGTTEPLEFLFLFVAPVLYVIHALLTGLGFTIMAVLGVTIGNTDGNIIDFVVFGILHGLATKWYLVPVVAAIWFAVYYAIFRFAITRFNLKTPGRDIDTAASVEKAVAGTIGKSGYNVPAILAALGGAENIVSLDNCITRLRLSVHDMSKVDAAALKAHRAIGVVQLNQHNLQVVIGPQVQSVKDEMATLMNTVQA

SEQ ID NO: 13907 - protein, 323 aa, Klebsiella pneumoniae
RRCRRRTLPGRVSLSNLTPMPGRVAIPPVTWRTRRRCEMGNGWHEWPLVLFTVLGQCVVGATIVSGLGWLALGDQREARRRLVRNMFFIWLLMGIGFLASVMHLGSPLRAFNSLNRIGASALSNEIASGALFFAVGGFWWLLAVLEKMPATLGKVWLAIAMLLGLLFVLAMTRVYQINTVPTWYNGYTTSAFFLTVLLSGPLFAALLLRLAKVDFNGWFFAGLSVAALVISAAVIIMQSAGLSTLHSSVQQAATLLPDYGKLQALRLVLLALGLGCWLCPLIRRQPPRATGLLIGLLLVLIAECIGRGLFYGLHMTVGMAVAG

SEQ ID NO: 13908 - protein, 133 aa, Klebsiella pneumoniae
RGRRAPSRAARPRYTAGRGYHPQSQSPPPSPPAAAGADRRCLRHTAATGGPTGSRTRFPSAPGQTAYSPGSARVCRYARRCRFPGCWSRGPAASRPSPDARRAQAGSRRPGCPVCRQTPPQSRHRAGRGCASP

SEQ ID NO: 13909 - protein, 621 aa, Klebsiella pneumoniae
DGRRVGGPHRRGGAEGGEQLRRRVGRLPDNLLIAALETHFTQQTQIRPRLRRQNALHEAAVGQGFHFIQPLQRRLFRVRETIAVILRGFIADGESGVVVRRADQAIKVCFKTRHMSSQDPLSEWQARRYRRRKRQRIADQRGHRPGTVVGGVPRCRAMVAGGAHPAKRRFTRCAGQRLVPVDDPGSRLVRQLIKLRRIAGDQPDGQAIAGLIGEANRLREAVVTDNRQQRAKVLFIRHLNTGDVDDPRGQHRGARVRLAHAQQHLAAEPLQFLLRRQHVLRSVERDHPAHKRRRLIIPLAGADLRAGLYQPLQQRIPLLAARHDQPARAGAALPRRDKRRLDNHMQRRIDIGHVGDDQCVVAAHLEGQHLLRLAAEVAMEVETGRRAAGEQHAVDITIFQQRLAGGFSALQQVDRPVGDARLLPQLDGHFSGSRRQLAGFKHNGVPGDQRRNDMSVGQVAREVVGAKDRHHAVRFVAQQRFTVRQRRLMKARPLVIGFDGDRGLADHRLHFGAGLPQRLAGLAGNQGRQRLFMRLQQRGKTLYDVNTLGQRPVRPGIKRRARRGAGRLDVVSPRAGRLPQQRLILRGQFAHRCAAAWQPLPGYKLCFYRHDLLSSGFRVTV

SEQ ID NO: 13910 - protein, 279 aa, Klebsiella pneumoniae
SCQRLCYYPGGIRFYLIMSDNGIAKYIMEYEMKHVHKLAWIGLFVNIIICFVARNLLLDEGQLNFHSRADGVWSWLVLALFIAVVVQAISIMLSGRYPYLAIVLAFVGGIVMVPASVIFMVGSLFSLQTRINAGFTPWRSTTAVGEADNQQLLTFNASGFYPQGALALIAGIIILMIGMGIGGVFIAAGIVALCNGYRLQNRVVIGVSGESMIFTPGLYADTYVIPLRDVAVVERSNNDAKVRLLIRSSGRSFTLRKKLLAGDKVNDAFAAILAKLTTV

SEQ ID NO: 13911 - protein, 86 aa, Klebsiella pneumoniae
DTRRFLAVDACGYARITLREASMYYASELTAQSIPISPEPNDPAPLPDPRPRPQPQPDPPPDEEPIKLSHQARRSARIRACRLSAF

SEQ ID NO: 13912 - protein, 144 aa, Klebsiella pneumoniae
RSRRSAKPSTPCPPCWSSCGQTRMTPCCAIAPPSPGGMACGGRWAPPGMPATSCRPRTLPAGCRPRADFLSQDRMTMNKLIPLIVLSCLLPLAANARTITATGDTLDHAESKIRQQAAREGATTYRITEARMGNKVHITAKIAD

SEQ ID NO: 13913 - protein, 78 aa, Klebsiella pneumoniae
RCGRGNRTTGQEKRMYYTLGDTTLHFYRYQCKFYVAHWEGGNVMSEKFKSFIEQITEKTGLDAKRVETAARDYFTNVD

SEQ ID NO: 13914 - protein, 346 aa, Klebsiella pneumoniae
PGGRPVMLFRPVRENDLDDIVRLAARAGVGMTSLPHDVGRLAARIRRSIETFAGELPRSQQGFLFVLEDTALARVVGVSAIEVAVGLDEPFYNFRIQKTVRASKALGVYKPQELLNLSYDHTGHSELCTLFLDPAYQRNRNGLLLSKARFLFIAAFREWFSPHLFAELRGCSDEQGQSPFWDALGHHFFDIPFADADRLTGTGMKTFIAELMPAYPIYISLLPEAARGVIGQVHPNTAPARAILEKEGFSWRGSVDIFDAGPVLEADTDQIRAVRDSQRLPVRQLMGDLPAPTLVANGQFDNFRALLVAHEEQVSLDSAALDALQVSETDRVYTVTLNPEDNRSWR

SEQ ID NO: 13915 - protein, 909 aa, Klebsiella pneumoniae
PCALGVPVREQRRAVACPEQIREDLMENPASLLRRLNPCCARAMEGAASLCQTRAHAEILPEHWLLKLLEQGEGDLTVLARRYEWDMDALWQDLLSWLDKQPRSVRHRPQLSDHTLRLMQEAWLIASLSGETQIRSVHLLMALVEKQNLIQCDGLWPLLTLGQRQLERLRPLLDAQSDERPPAQQEAALAQPHGGDVEFVGRPAGSELNADGLNPVLQNALDKFTLDVTAKARDGQIDPVFGRDKEIRQMVDILSRRRKNNPILVGEPGVGKTALVEGLALRIAEGNVPDALKPVSVRTLDLGLLQAGAGVKGEFEQRLKNIIEAVQQSPSPVLLFIDEAHTIIGAGNQAGGADAANLLKPALARGELRTIAATTWSEYKQYFERDAALERRFQMVKVDEPDDDTACLMLRGLKSRYADHHGVHITDDAVRAAVTLSRRYLTGRQLPDKAVDLLDTASARLRMSLDTVPQPLTRMKAQLTALAMEKQALLEDIALGNSARGDRLAAIEQEEIRLILALDTLETQYGQELQLTEALLACRRDISRQAEISDLQTALIAVQQGNPLLGLDVDVRTVATVIADWTGVPLSSLMKDEQTELLSLEESLGKRVVGQEAALSAIARRLRAAKTGLTPENGPQGVFLLVGPSGTGKTETALALADALFGGEKALITINLSEYQEPHTVSQLKGSPPGYVGYGQGGILTEAVRKRPYSVVLLDEVEKAHRDVMNLFYQVFDRGVMRDGEGREIDFRNTVILMTANLGSDLLMQLLDEQPEASESDLHELLSPVLRGHFQPALLARFQTVIYRPLPAGALRAIVGMKLGQVSQRLACHYGITTTLSESLFDALTEACLLPDTGARNVDSLLNQQILPALSQQLLSHMAAGQKPRQVTLGYHEEEGVVMAFDEGTISDE

SEQ ID NO: 13916 - protein, 504 aa, Klebsiella pneumoniae
NRPRLYGNPESRGQQIMAVKAQFIAGQWLPGSGATMSKLAPEDQSLLWQAASAGADDVQAACAAARAAFYPWSHRPLAERIDVVQRFAALLETHKEALATLISRETSKPLWETRTEVQAMIGKAAISIEAYHQRTGFHESTLPDGKALLRHKPHGVMAVFGPYNFPGHLPNGHIIPALIAGNTIVFKPSELTPATAEMTVQLWQQAGIPDGAINLLQGGKATGQALLENRDIDGVLFTGSAAAGFHFHRYFGGQPEKMLALEMGGNNALIVADVADIDAALHVIIQSAFISAGQRCTCARRLIVPRGEQGDALLQRLVEASAQIRAGKWDDQPAPFMGGVISLDAAQNMLAAQQKLEGLGGKVLLRMRQPDPRSTVLTPGIVDVTGIEVPDEEYFGPLLTIIRYDGFPEAIRLANQTRYGLAVGLISSDAAQFDQLADEARAGIVNWNKPLTGASSKAPFGGVGASGNHRAAAWYAADYCAWPMASLVSDTLTLPATVSPGLPF

SEQ ID NO: 13917 - protein, 81 aa, Klebsiella pneumoniae
SPPRPGCSSMPASGRLSPTTGWKTCALLSRSNRATPFRFASPVSGKRSNVSAAPMRKPPAWWNGRWRFSTSTSRRWRCIPF

SEQ ID NO: 13918 - protein, 583 aa, Klebsiella pneumoniae
RSARRDPDGDYPTGAGANPAGAGKAVARSGEEIMPRRQDNPYAPHDWAPHEKPALLGSPSTPLHSPAKRLAYGVVGLLVCLTGALGNAVVTANLQLLQGTFAAWSTEIAWLPAVYVMTNVSINLLLVKFRQQFGLRAFTEGFLVLYVLVTFFHLFVNDLSSAMMVRAAHGMVAAALSSLGIYYQVQAWPARHRLKGLTIGITGSSLAIPLARLFSTELLQTDEWRGLYFFELGLALVSLACVIALKLPPSDRKKVFEKKDFITFFLLAPGMALVCAVLSLGRLEWWFEAPWIGWALAAAVILIVAAITFEHNRSNPLLNTKWLSSGSIVRLGLIMLLIRIVLAEQNTGVIGWLQYVGLQNEQMTNLAWSIFAGILCGIIASCLTLNPQKLYWPTATALALIMIASLLDSQSNALTRPEQLMFSQFLLGFGSAFFLAPAMLAGIGGVFADPRNLVSFSVLFGMSQNIGGLLGSAILGTFQTWREKFHSSQLADQITTLNPLIVERLQQYSQMYQSQIGDSTLLNVQATTLLQNAATLQANILAWNDTYLLTAAISAGTLVWVFWRLIRLRLTARIALQRATGSK

SEQ ID NO: 13919 - protein, 327 aa, Klebsiella pneumoniae
MAARRARAAENVPRRALNRDAVAQGGIMKILFTFPGQGGQRPGMLAALPDREAILTQARAVLGNEVATLDSADALQHTRAVQLCLLIAGVAWARELQRQGVDPQMVSGLSIGAFPAAVIAGALDFASALRLVALRGDLMEQAYPEGYGLTAIMGLTRPRVEALMQGHEVYLANLNAETQFVIAGRDEAMAEVAQLALRAGASKAQRLAVSVPSHCALLDKPAAELAKAFAGASLRRPRCAYLSGSTARVLWDPQRIADDLAMNMARPVHWQEAMVAADERDARLAIEMPPGGVLTCLTRQAGWHGETIALERSGLDVARHLAQRLSD

SEQ ID NO: 13920 - protein, 822 aa, Klebsiella pneumoniae
IKQRRKNRVQLVMLIDRDGIRLMGERKGQQATSQARQLRVEAFRRALPVTQKVPQHRFGAVQRIQQPEQRDIGYGKISHPFIAFATHGHQARQTSPELDEQLFKLRRQPAAALDLQQRREKRLVDKPGPLRVPLQANKRTGQVIAVVLVGEAEGQLRLYDGNLPGIIPELVADIAPALAEAHRPFGHLLRLQTVAAIRLHQGQRQHDHRHAGRAVQRQRGRQRIGIVRINHRAILEPDLQPVSLQAAQFEHLWFEGRLNHSPGVVKTHPGNHFRSPGCIRSLLLKMLRRHHNAPAPQRTFRFHHRPNLRLRLWHLANQRQIDVHPLDLEVRHRVQLHSEEARVILDIFHHHAGIAQRMGGLQLVAGVGHFGHQAPHPGVQLQLQQTPVLGGADILALDHLQVVRDARQQEDIRQTRVDTAVGGGVGGIVQRRFLRGVGREEAGVIAIFVVRQRDKAQAGELKLPRFRDHHLGRNFHLVAGAQIVQMDGQIFHRAAGLRTANLHAPAVIDKALHHIGCEGERRAGPEILFVVRTFHLLDIVEAAHRHGVRTVRQTTQHARHHQTDVAGIVSFAKRLPANIFRTIEVVADILNGSHLFHGLFQEEGRADGADKRHMGGRRDAGDIAQQRHILRAGVELIGRDHRADRLAAGSVILRGIGVPVEAALDKLRRVLKVLAQIVFGDVEDLRFDVLPIVGVVHQLFEAAPQGFDLLKLLMVHHRVQLTAYLEIQLGDMVVDQRFVELFHPLAGLTDAFHKHLHRRGETLRRRRLGERGIVQKVVDIPEARRRGEINFFKQRGVNALARPVFLQRGLPLNRGVFCGNRH

SEQ ID NO: 13921 - protein, 224 aa, Klebsiella pneumoniae
MGKRHMQQQWSAVDNYLIKALIPGDPVLDRVLENNHRAGLPAHDVAANQGQFLALLVRLTQAKRILEIGTLGGYSTIWMARELPADGQLLTLEADAHHAQVARENLQLAGVDQRVTLREGPALQSLEALGECPAFDLIFIDADKPNNPHYLRWALRYSRPGTLIIGDNVVRDGEVVNPQSADERVQGVRQFIEMMGAEPRLTATALQTVGTKGWDGFTLAWVNA

SEQ ID NO: 13922 - protein, 427 aa, Klebsiella pneumoniae
GRRRALAVSYTDKLRLRGGVVLLRSGVILLRLAFLRRAVRQRRRFQTKHRGKVLQRHFLSVQRHLAVRVLQTAADGVIFHGGNAEHLAHRRQAFDLLIGKLGGIGRLIAFQTGDLSHKLRRHIHRDHHFAVQGLHHAIQAVRQGLRRSGHLGRIFQQNREVEGAFAFGIAPAQRRDGHRRVAFEQDRQRIEQRFGEGLLIQLRILRQLRFRQQRLRLRAVLLTELVPRLTVDVIHFQREFAAAHILPLQLEAVDGVVHLAVHAFAVLGQRRAAVQRHAVDQRQLFAFDADGQFIEGHFLLADTFVEAGQLGGAVGGQVDEAQLYLLIIFIERIDLPAAGLALQADVFAVAVGVELELTAAEGDFLIAFSVVEGVKDDSRLAVAAVGNARIDGKGGVAFGYLEQRLAGVVFHQRGVDGSHCRRQIKGF

SEQ ID NO: 13923 - protein, 61 aa, Klebsiella pneumoniae
MKKLLLAMAASMLLAGCTPRIEIAASKEPITINMNVKIEHEIHIKVDKDVENLLKSRSDLF

SEQ ID NO: 13924 - protein, 146 aa, Klebsiella pneumoniae
LRKLPVISPSITHWGSASLSTIAGFLPPSSSVTRVRRSAATRAICFPVAVEPVKLTFATCGWAVSAAPQPAPLPVTTLNTPSGMPAWVASSATRSRVSGVVSEGLMTIEQPAARAGMTFHMPIISGKFHGTMPATTPTGSFLVHAW

SEQ ID NO: 13925 - protein, 136 aa, Klebsiella pneumoniae
AFSRGNAMEDKQRYQDGMAVRRKVLGDAHVDRTLQHLTPLNDEFQDFITRYAWGETWTRPGLDHHTRSMITIAMLIALNREAELKMHLRASFNNGVTRDELKELIMHSALYCGLPAANATMHLAQQVFDDIDAAQG

SEQ ID NO: 13926 - protein, 303 aa, Klebsiella pneumoniae
DPFRQVLKPEYALFPGKRERTERNGQKITRIGQPGPVSLPYCKDSTHQRGPNMTKIALITGANRGLGRQTALDIARQGGDVIVTYRGSLEQAEAVVADIRALGRKAIALPLDMAQTASFPAFADSLGSALASVWGRATFDHLINNAGHGEFAPLAETREAQFDGLFNVHVKGVFFLVQTLLPLLADGGRIVNFSSGLTRVSYPGFSAYAAAKAAVEMLSVYMARELGGRGITVNTIAPGAIATDFGGGLVRDDAEVNAQFAAMTALGRVGVPEDIGPMIASLLRDDNRWVTAQRIEVSGGQTI

SEQ ID NO: 13927 - protein, 141 aa, Klebsiella pneumoniae
RTSRVSVTPDRFLMLNIDKYLTVRWQMGGRTFPVLDCYGIVHEVRRDLGLPEWPAFEAVIKERGSTEMGEVCESFTRDLTPCKPCNGAVAACYMGNMIGHLGVVVEMEGALYVIECNPRRNVTILPLARFERQFLKVEYYQ

SEQ ID NO: 13928 - protein, 926 aa, Klebsiella pneumoniae
LMTSNERILQPFTLPNGTELKNRLLMAPMTTCTGYFDGTVTSELVEYYRARAGSIGTIIVECCFIDDYGLAFPGAIGIDNDEKIAGLAKIAEAIKAEGSKAILQIYHGGRMVDPQLIGGRQPVAPSAIAAPREGAAMPRALSGEEVEGMIAKFGDGVRRAILAGFDGVEIHGANTYLIQQFYSPNSNQRDDEWGGSRDNRARFPLAVLDITHKMARQYADDAFIIGYRFSPEEMEVPGIRFDDTMYLLEKLAARGVDYLHFSVGATLRPSIVDTSDPTPLIEKYCAMRSDILAQVPVMGVGGVVNAADAEQGLDHGYDLIAVGRACIAYPDWASRIAAGEELELFIDSTQREALHIPEPLWRFSLVEAMIRDMSMGDAKFKPGMFVETVHDDANELVINVSLENDHIADIELAASPVQTVEFTTSFEEIRERILTANTPHVDAISGATSQSEAVKKAVAKAMLKSSKALAAEEGGNDAAPKSYDVVVVGSGGAGLAAAIQAHDEGASVLIVEKMPTIGGNTIKASAGMNAAETRFQRVKGIEDSKELFYQETLKGGHNKNNPQLLRRFVENAPQAIEWLADRGIMLNDITTTGGMSIDRTHRPRDGSAVGGYLISGLVRNITKRGIDVLLDTSVEEILMRGDEVSGVRLINDEKEVIEVQTKSIVVATGGFSANSAMVVKYRPDLEGFVTTNHKGATGSGIALLERIGAGTVDMGEIQIHPTVEQQTSYLISESIRGGGAILVNQQGNRFFNEMETRDKVSAAIIALPEHYAYIVFDEHVRAKNKAADEYIAKGFVTSASSPRELAEKLGMDYHAFLATLECYNGAVEKQHDEQFGRTTALRAPINEGPFHAIRIAPGVHHTMGGVTINTDGEVLNVAQQPIRGAYAAGEVVGGIHGGNRIGGNAVADIIIFGTLAGHQAAKRARG

SEQ ID NO: 13929 - protein, 100 aa, Klebsiella pneumoniae
ASASRCVPSGIPENATPVALPYASVTLAVIAGLPPLDAVPEVNTGLSPKTATGSDDEVMFPPSQGLDASAISTTPPLSCASNPDPVRPSFITASRPGIFT

SEQ ID NO: 13930 - protein, 429 aa, Klebsiella pneumoniae
APARKLMPTLNAPCWPPAPSTGWWRTIPNSTAANRGGWPDSATFTIFFLIVPGLSWGMTPPSLYILLTLNNVENLMSNNTINIALIGYGFVGKTFHAPLIRSVPGLNLAFVASRDEEKVKRDLPDVTVIASPEAAVQHPDVDLVVIASPNATHAPLARLALNAGKHVVVDKPFTLDMQEARELIALAEEKQRLLSVFHNRRWDSDYLGIRQVIEQGTLGAVKHFESHFDRFRPEVRVRWREQNVPGSGLWFDLGPHLIDQALQLFGLPQSVQGNIATLRDGAEINDWAHVVLNYPAHKVILHCSMLVAGGSSRFTVHGDKGSVIKARADQQESQLLAGVVPGSADWGQDDDPLVIYDASLQAHAQATPQGDQRQYYMLIRDALKGQIANPVPPVEALAVMAVLEAAVRSAESGMVQTLDLSDDERNTLH

SEQ ID NO: 13931 - protein, 255 aa, Klebsiella pneumoniae
GLSRHMIPEKRIIRRIQSGGCAIHCQDCSISQLCIPFTLNEHELDQLDNIIERKKPIQKGQTLFKAGDELKSLYAIRSGTIKSYTITEQGDEQITGFHLAGDLVGFDAIGTGLHPSFAQALETSMVCEIPFETLDDLSGKMPNLRQQMMRLMSGEIKGDQDMILLLSKKNAEERLAAFIYNLSRRFAQRGFSPREFRLTMTRGDIGNYLGLTVETISRLLGRFQKSGMLAVKGKYITIENSDLLAQLAGQARNVA

SEQ ID NO: 13932 - protein, 321 aa, Klebsiella pneumoniae
ICKRKLNQECGRAMKDDINQEITFRKLSVFMMFMAKGNIARTAEAMKLSSVSVHRALHTLEEGVGCPLFVHKGRNLLPLQAAWTLLEYCQDVISLMNRGLEATRKVAGVGQRRLRIGTLYSLTLETVPRIIMGMKLRRPELELDLTMGSNQMLLDMLEDDALDAILIATNEGEFNNTAFDVVPLFEDDIFLAAPATERLDASRLADLRDYADRKFVSLAEGFATYAGFREAFHIAGFEPEIVTRVNDIFSMISLVQAGVGFALLPGRMKKVYEKDVQLLKLAEPYQMRQLISIVYSHHRERDADLLALAAEGRMYARSINR

SEQ ID NO: 13933 - protein, 594 aa, Klebsiella pneumoniae
HLGRPVESVRAVADGTVISLRKSSDKRDLAPFNINADKPNTKGSNDGYVLIKHETEIGSGDEGKVAFYSLYIHLKSLAETVKAGDKVYRKDPLGLPGMVDGVNAFHFQIFCDDDNISKLTGRKTGELDISKNGRTDAVYGDIHFYLPPQTKFYDKAPADNSISTTGLSELYTSNVPLYASMTLAQGKCTMVTRQKNTQTDGKYDLLGEPLVNADGDDYEYNLYKTAMRNYKESPSAGFELLRFGRVINTDHETLVPADAPLWMTVNYPGGKGVINLADSSIKKFSDADFPHWTGWQMVDDDSDSNSQCNSAIIKKLHEVGDFDNQCGKLICHFPFEWEKSTIDIRFSWLKTGKEEHEPMTEADYAKFKSHAEALCFDSGALSSDRLWHFEPKSFIRHFRKCSWLDSEVIEKVMMANASKKNKNALEGIKNITLEYYADINTIMRKYNLSDANRICHFLGQGAVESGYLLSMQEASQQQIIVDGVQQGGVIVEASTFNETTKLGHWYGALKAEKDNYFSGKKYNSRGGYITGSYSWINGNCGDVDAQKFRGRGFKMLTGLNTYSSYWVYRGWLSKNDFDKYWWDDPEYKKKIQPV

SEQ ID NO: 13934 - protein, 125 aa, Klebsiella pneumoniae
GLGRGRMGARSRAGPCAKTAGPQRGMTRDNMSKVYWPLYEVFVRSKQGLSHRHVGSLHAADDQMALENARDAYTRRSEGCSIWVVKASEIVASQPEDRGEFFDPAESKVYRHPTFYTVPDGMEHM

SEQ ID NO: 13935 - protein, 432 aa, Klebsiella pneumoniae
ITLRNRTLMEKLSYASESSTSPWTTYLRQIDRVAPYLGDLAYWVETLRHPKRALIVDIPVQMDDGTIRHFEGYRVQHNLSRGPGKGGVRYHPDVDLNEVMALSAWMTIKCAAVNIPYGGAKGGIRVDPFSLSEGELERLTRRYTSEIGIIIGPQKDIPAPDVGTNGKVMAWMMDTYSMNHGTTITGVVTGKPIHLGGSLGREKATGRGVFVTGREVARRAGIEIEGAKVALQGFGNVGSEAARLFAGVGARIVVIQDHTATLYNEGGIDMAALTAWQAEKKQIAGFPGAQEIDKDAFWTTPMDILIPAALEGQITRERAEKLTCKLVLEGANGPTYPEADDVLAERGVIVVPDVICNAGGVTVSYFEWVQDMASFFWSEEEINAKMDRIMTDAIVHVWDKAAEKECTLRTAAYIVACERILMARKDRGIYPG

SEQ ID NO: 13936 - protein, 135 aa, Klebsiella pneumoniae
LPSRAPSRAAVWAKCPAPKWPPRWSWRRKITATVSRRRRCCASKPAAYVCRRPTSVWPPSPIFTPRLSTCAATPQWSASSPAPSAALAVCLSPPRCAVTLSSLVKPVSVSTARRLSSRKPALKSTTPATGRLSGA

SEQ ID NO: 13937 - protein, 687 aa, Klebsiella pneumoniae
HIWRFAMQQLASYLSGAWQTGRGRARTIHHAITGAALWEVTSEGLDMAQARRFAIERGGKALQAMTFIERSAMLKAVAKHLLEQKDQFYAISAQTGATRADSWVDIEGGIGTLFTYAGLGSRELPDDILWPEDELIPLSKQGGFAARHVLTSKSGVAVHINAFNFPCWGMLEKLAPTWLAGMPAIIKPATATAQLTQAMVKAIVDSGLVPEGAISLICGGAGDLLDHLDSQDVVTFTGSAATGQQLRTHPNLVAKSIPFTMEADSLNCCVLGEDVTPEQPEFALFIREVVREMTAKAGQKCTAIRRIIVPLAQINAVSDALISRLHKVTVGDPAQEGVKMGALVNSEQRQDVQESVNKLIAAGCEVLLGGEADLSAAGAFFPPTLLYCSQPDETPAVHAIEAFGPVATLMPYRDRQHALTLARAGGGSLAGTLVTASGELAREFILGAARAHGRIQILNEASSVESTGHGSPLPQLVHGGPGRAGGGEELGGLRSVKHYMQRTAIQGSPTMLATIGQQWVRGAQVSEDRIHPFRKYFEEIQPGDSLLTPRRTLTEADIVNFACLSGDHFYAHMDKIAAAESIFGERVVHGYFLISAAAGLFVDAGVGPVIANYGMENLRFIEPVKPGDTIQVRLTCKRKTVKRQRSADEKATGVVEWAVEIFNQHQQAVALYSILTLVARQQGDFPA

SEQ ID NO: 13938 - protein, 97 aa, Klebsiella pneumoniae
KPWSQSTLERGWKNKVIKKFNTGGDVKYYYVLALLLGYSSCVLAEECMDNSNIDSLREVFKKNNKKLLIEMSSKEMRRYVESDLLIKNKYSTHCQCI

SEQ ID NO: 13939 - protein, 349 aa, Klebsiella pneumoniae
AWRSFITSSRFTNRRISMSKLGINGFGRIGRLVLRRLLEVDSSLEVVAINDLTSPKVLAYLLKHDSNYGPFPWSVDFTEDALIVNGKTITVYAEKEAQHIPWQAAGAEVIVECTGFYTSAEKSQAHLQAGARKVLISAPAGEMKTIVYNVNDDTLTPDDTIISVASCTTNCLAPMAKVLQDAFGITVGTMTTIHAYTGTQSLVDGPRGKDLRASRAAAENVIPHTTGAAKAIGLVIPSLSGKLKGHAQRVPTKTGSVTELVSVLEKKVTAEEVNQAMRQAAEGNESFGYTEEEIVSSDIIGSHFGSIYDATQLEIVEAGGVQLVKTVAWYDNEYGFVTQLIRVLEKFAR

SEQ ID NO: 13940 - protein, 159 aa, Klebsiella pneumoniae
RIILKKTKTLTGISLFIAVLVLVAHFIPIRPVVVIINNTNETIFVYAGESIYNVEPEPDEVARIVRSKPEIIAPGKRVKIKASFTSLIRKDAALDIGWRVGGQYEYNAAGSGGQNFILSSKEGVCYASIYIKDDFFKGAIKNGSSNKCLKKIKAFNYKY

SEQ ID NO: 13941 - protein, 144 aa, Klebsiella pneumoniae
KQFGLFVNGKKTISFEQFLTINSNLVSISDTWADLWALIFHTGLSAGRLLSIRYDDIDDGLILIRKQGHLKELRVESTPPVEGIIARRRERYPEDVFLFQSHSNRVKYQRRPVTIIAFNAALRRAARSLPDVNVSSSSARNIPD

SEQ ID NO: 13942 - protein, 463 aa, Klebsiella pneumoniae
HMSGGLVTAAYIVAAILFIFSLAGLSKHETSQQGNYFGIAGMAIALIATILGPDAGNVGWIILAMVIGGAIGIRLAKKVEMTEMPELVAILHSFVGLAAVLVGFNSYLQHETGMEQILVNIHLTEVFLGIFIGAVTFTGSVVAFGKLRGKISSRPLMLPNRHKLNLAALVVSFILMVIFVRSDSTGTQVLCLLVMTAIALAFGWHLVASIGGADMPVVVSMLNSYSGWAAAAAGFMLSNDLLIVTGALVGSSGAILSYIMCKAMNRSFISVIAGGFGTDGSSSGGDEEVGEHREISAEETAEMLKNSHSVIITPGYGMAVAQAQYPVAEITEKLRARGIKVRFGIHPVAGRLPGHMNVLLAEAKVPYDIVLEMDEINDDFSDTDTVLVIGANDTVNPAAQDDPKSPIAGMPVLEVWKAQNVVVFKRSMNTGYAGVQNPLFFKENTHMLFGDAKASVDAILKAL

SEQ ID NO: 13943 - protein, 120 aa, Klebsiella pneumoniae
PCAGGAGRTIAIRTPASIERKGRRTEGAAMSFEIIAGLVVVILGAIAGAFGIGHARGASKAKAKADQQRTEENAAATVAAAERRAEVTKGASDVQEDVKRMGDDDVDRELREKFTRPGSR

SEQ ID NO: 13944 - protein, 294 aa, Klebsiella pneumoniae
SKYGAIIEHRLSLAKECDRWQIWGTEMDKHPDDLLTGDGDPFKGDPNFMASLARGLEVIQAFTPQRPLLSISQISQKTGIPRAAVRRCLYTLSKLGFVYAEDGKNFQLRPRILALGHAWLASTPLARSAQPVLRHLSEMLNESCSIATLDGDDILYIARASSSRIMTIDLDIGSRLPAWATSMGRVLLSHQPEEKLNDMLARVTMIRYTPQTVDSVAKLRAELKRVHQQGYALNDQELEMGLRSLAVPLFNAQGQVQAALNVGVHAGQMTAREMIERVLPELQKAARELTLLLR

SEQ ID NO: 13945 - protein, 1323 aa, Klebsiella pneumoniae
HRCGTLRQYFKRDFPGRALPDNAMTEQQKITFPQLYQQLDGLMLRDKTRFARRLHGVKKVKNPESQQAILQEMALEISQAAGKVLLREAARPAITYPENLPVSQKKQEILEAVRDHQVVIVAGETGSGKTTQLPKICMELGRGLKGLIGHTQPRRLAARTVANRIAEELQSEPGGCIGYKVRFSDHVSENTMVKLMTDGILLAEIQQDRLLMQYDTIIIDEAHERSLNIDFLLGYLKELLPRRPDLKIIITSATIDPERFSKHFNNAPIIEVSGRTYPVEVRYRPIVEEADDTERDQLQAIFDAVDELGREGPGDILIFMSGEREIRDTADALNKLDLRHTEVLPLYARLSNSEQNRVFQPHSGRRIVLATNVAETSLTVPGIKYVIDPGTARISRYSYRTKVQRLPIEPVSQASANQRKGRCGRVSEGICIRLYSEDDFLSRPEFTDPEILRTNLASVILQMTALGLGDIAAFPFVEAPDKRNIQDGVRLLEELGAITTDAQATAYKLTPLGRQLSQLPVDPRLARMVLEAQKHGCVREAMIITSALSIQDPRERPMDQQQASDEKHRRFHDKESDFLASVNLWNYLGEQQKALSSNQFRRQCRVDFLNYLRVREWQDIYTQLRQVVKELGLPINSEPAEYREIHTALLTGLLSHIGMKDADKQEYTGARNARFSIFPGSGLFKKPPKWTMVAELVETSRLWGRIAARIEPEWVEPVAQHLIKRSYSEPHWERSQGAVMATEKVTVYGLPIVAARKVNYSQIDPALCRELFIRHALVEGDWQTRHAFFRDNLKLRAEIEELEHKSRRRDILVDDETMFEFYDQRISHDVISARHFDKWWKQASRETPDLLNFEKSMLIKEGAEQVSKLDYPNFWHQGNLKLRLSYQFEPGADADGVTVHIPLPLLNQLEEAGFEWQIPGLRRELIIALIKSLPKPVRRNFVPAPNYAEAFLGRATPLELPLLDSLERELRKMTGVTIDREAWQWDQVPDHLKITFRVVDDKNKKLQEGRSLQALKDALKGKVQETLSAVADDGIEQSGLHIWSFGTLAESYEQKRGNYKVKAWPALVDERDSVAIKLFDNPQEQQQAMWRGLRRLLLLNIPSPIKYLHEKLPNKAKLGLYFNPYGKVLDLIDDCISCGVDKLIDEAGGPVWTEEGFSQLHDKVRAELNDTVVEIAKQVEQILTAVFNINKRLKGRVDMTMALGLSDIKAQMAGLVYRGFVTGNGFRRLGDTLRYLQAIEKRLEKMAIDPHRDRAQMLKVESVQQAWQQWLNKLPPNRREDDDVREIRWMIEELRVSFFAQQLGTPYPISDKRVLQAMEQITP

SEQ ID NO: 13946 - protein, 166 aa, Klebsiella pneumoniae
TGSGLNMTAINRLYASSGSEVIIGTLQIDIGGQTHYLCEGYEDITAVTEGGETVTFIACAIVLSLPARNEDGTQDLKFMLCNVDGVVSTAIRKVIDAISTASITFRKYISTDLTAPAEPPYVMPVKGGSWTPLTVNVTAGFKNMLDYAWPRDRYTLTYFQGLRYSR

SEQ ID NO: 13947 - protein, 636 aa, Klebsiella pneumoniae
SGFGGGDPELRQLCVCLFRADRDRLGSGYDSLFQSGAGDRRRGDLCRGAVLLLYRQNSHRLATLGDSSTAGPQGRAAAMFFSSRYLRYPVTAAIAATCPVLYQVRSSCMVVDRNQRCYTNCVRWLRHKGILLESSPREWLMGYITTRVIMENTLLTANATLPTYDRSALIPRIVHLGFGAFHRAHQAVYADILASEHGSDWGYTEVNLIGGEQQIADLQQQDLLYTVAEMSADAWTARVVGVVKQALHAGVDGLEAVLAAMCQPQVAIVSLTITEKGYCHSPASGELQLDHPLIAADLHNPHQPKSAAGVVVEALSRRRAAGLPAFTVMSCDNMPENGHVMRNVVCAYARALDEDLAAWIEQNVTFPSTMVDRIVPAVTAETLDKITQLTGVRDPAGVACEPFRQWVIEDNFVAGRPQWEKAGAELVADVVPFEEMKLRMLNGSHSFLAYLGYLAGYQHINDCMQDDNYRRAALSLMLDEQASTLKVQGVDLSRYASLLIDRYCNPALKHRTWQIAMDGSQKLPQRMLDSIRWHLVHQRDFTLLALGVAGWMRYVGGVDDAGQAIEICDPLLPVIQQAVAASADGEARVKALLGIEAIFGVELPQESRFVTAVTRAYLALQRQGAKATVAAWAAAQ

SEQ ID NO: 13948 - protein, 189 aa, Klebsiella pneumoniae
TPAGYRTNPLRHPRMMALHYTMESNSMAIPVYLWLKDDGGADIKGSVDVQDREGSIEVVAQEHNLYIPTDNNTGKLTGTRIHTPFLFTKEIDSSSPYLYKAVTTGQTLKSAEFKWYRINDAGQEVEYFNTKLENVKVVKVNPLMHDIKNPAYEKHNHLEQIELRYEKITWTYKDGNIIHSDSWNERATA

SEQ ID NO: 13949 - protein, 236 aa, Klebsiella pneumoniae
TFCGTTNVNEPKRGNAASIDIDALLPNTWFRVISLRLGPQFRDEKGYTLWQRCIADVERVQHELKASGLDDASCQHILTAQCALLDEAVKGRGVEDEACLQWYDIPLQGHFLGTMDAGDTLCERMRDVLREPAPNLAVVTCFQRVMLLGFIGSFRSLHDPERLKLVNALGERVPPFQCPATAPVLVESRAGLGISGWLAPWPVRIGLSVVVVLALWWGLNHWLDHLLLTLLPGEVK

SEQ ID NO: 13950 - protein, 466 aa, Klebsiella pneumoniae
YPCGETTMIRPVALAIVLALVGCQSADVQRAQPTLTIPAAWRADVGPASPVEGVWWRNFHDSTLNQYVDRALRYNSDVLIARERVNEYQARAYAADSSLFPSLDASLTGTRARTQSAATGLPIHSTLYKGGLTASYDVDIWGANRSAANAAGASLEAQKAAAAAANLSVASSVAVGYVTLLSLDEQLRVTQQTLTSREDAWRLAKRQFETGYTSRLELMQADSELRSTRAQIPPLQHQIAQQENALSVLLGDNPGAVKRGEFAQLTPLRLPSQLPSTLLNRRPDIAQAERQLVAADATLASSQAQLLPSINLTATGSLQDRTLPDLLDNPLRLWSLGGSILAPLLNRQALNAQVDVSMAQRNQALYSYEKTVRSAFKEVNDSLDAISRYGEQLTELQEQETVAQETLRIAQNRYRNGYSSYLDVLDAQRTLFSTQLSVVQVKNNLLLAQIDLYRALGGGWSDSSGS

SEQ ID NO: 13951 - protein, 154 aa, Klebsiella pneumoniae
GAGGWRLRQFRRARRPGPPGRNHAGAKRLAGRRRRSPCRHPVSRQSCRLTHSEDVMEQITLSFPASRALSGRALAGVVGSGDMEVLYTAAQSATLNVQITTSVDNSQARWQALFDRLNLINGLPAGQLIIHDFGATPGVARIRIEQVFEEAAHA

SEQ ID NO: 13952 - protein, 402 aa, Klebsiella pneumoniae
IMSGSMTREDFDAYLVPCFAPAPFIPVRAAGSRVWDQQGKEYIDMAGGIAVNALGHAHPALAQALQDQLAKLWHIGNGYTNEPVLQLAKTLVQSTFADKVFFCNSGAEANEAALKLARKYAHDKFGGEKSEIIAFNHAFHGRTLFTVSVGGQPKYSSDYAPLPQGITHLPYNDIEAVTAAISSRTCAVIVEPIIGEGGVIPADPAFLQALRTLCDRHHATLIFDEVQTGAGRTGHLYAYQHYNVVPDILTSAKGLGGGFPIGAMLAKEAWAQVFQPGTHGTTFGGNPLAATVANAVLAHLDAPLLAGVGERHALIVDQLNAISARYDAFSAVRGTGLLIGAELAGPLRGKAKTLTNLAAEEGLIALIAGPDVLRFAPALNIPLADIAEAFVRLDRAVARLTR

SEQ ID NO: 13953 - protein, 79 aa, Klebsiella pneumoniae
AARGDIMFRFLHQTEDIMDTELTPTQMAIEFLRRDPTVMTPAQYLKKLKLLELEFADLMALSSLELKEEIDLAWRLGIH

SEQ ID NO: 13954 - protein, 458 aa, Klebsiella pneumoniae
  UNSURE (407),(421): Identity of amino acid at the above locations are unknown.
KKLGLSALTALVLSSMLGAGVFSLPQNMAAVASPSALLIGWAITGVGILFLAFAMLLLTRIRPDLDGGIFTYAREGFGELIGFCSAWGYWLCAVIANVSYLVIVFSALSFFTDTPELRLFGDGNTWQSIVGASVLLWVVHFLVLRGVQTAAGINLVATLAKLLPLGAFVALAALAFQLDTFRLDFSGLALGVPVWEQVKNTMLITLWVFIGVEGAVVVSARARHKRDVGRATLLAVLSALAVYLLVTLLSLGVVPRSELAEMRNPSMAGLMVRLMGSWGEIVIAAGLIVSVCGAYLSWTIMAAEVPFLAATHKAFPRLFARQNSNNAPSASLWLTNISVQVSLVLIWLTGSDYGTLLTIASEMILVPYLLVGAFLLKIATRPLHKAVAIGACIYGIWLLYASGPVHXLLSVVLYAPGLLVXLYARRTHQHDRSLKRREVALIGLLLVAAVPATWMLVG

SEQ ID NO: 13955 - protein, 357 aa, Klebsiella pneumoniae
RAPGDGRRGGRDHRYRPWCGRQTRRRAASERQSGLPGRSRDSPQRCHPLPAGRRQRRRPGGVVRRTVQPTGKIPELVMKNLSPLHAESRVSWLAHTASACLIDEARLSPKPGLVDSRGNGAHQDLNLALMERSARSLQPTFHALAEQSWRRPADIALRETVGRLGREGEAQMMLATGGVNTHRGAIWALGLLVSAVAMLGGEGQSQAIADAAAALARLPDGFAPKSFSKGLRASRRWQVPGAREEAQCGFPHITRLALPQLQHSRARGASEPQAQLDALMAIMTSLSDTCVLSRAGMAGLQAMHQGACEVLAAGGCASFAGRAALARLDAIMLALNASPGGAADLLAATLFLDRVAG

SEQ ID NO: 13956 - protein, 209 aa, Klebsiella pneumoniae
CPQGSYMTNFLFNIKNHYLRVAIAELVDEAMKAAGRPHYQFSQQWDAGSMAQADVIFTEMVAGEWYLCQDLFQHAPEQYTLFIFPDNEHATVDEGLPNCLQHAVFMPPHTRVQRLKDEIANAIERPLLPRQDPPFNRLRRCINCACRSVSDAQTKVIYAFSIGLSPHEVAAALNISPKTIHSHKKNIMSKFNLNSRQQFNNLVQLLAKR

SEQ ID NO: 13957 - protein, 176 aa, Klebsiella pneumoniae
STQGTYGENQLGEENSLMAITTTLYYPADVLPGPLKDGFGMKPKSPVKITELVTGRKRIRRGYTSVPTETDVAWIFTDAQAQAFEAWYRDVLKDGSAWFNMPLLTPVGQKNYVCRFNDIYEGPTPEGGLYWRYSASLELWERPLPAVGWGEYPEWIVGSSLLDIALNREWPKHDSD

SEQ ID NO: 13958 - protein, 372 aa, Klebsiella pneumoniae
SRRGYALCLTYCIYCGLQKVLRRLSQKEQTKFVVLFNQYVTFNKQSDSHKCFCCEYRNHKGDDVTEEQRFDQRIAQETAIEPQDWMPDAYRKTLIRQIGQHAHSEIVGMLPEGNWIIRAPTLRRKAILLAKVQDEAGHGLYLYSAAETLGCAREDLYQKMLDGQMKYSSIFNYPTLSWADIGVIGWLVDGAAIVNQVALCRTSYGPYARAMVKICKEESFHQRQGFEACMALAQGNDAQRQMLQDAINRFWWPALMMFGPNDDNSPNSARSMAWKIKLHSNDELRQRFVDNTVPQVEILGMTVPDPDLQFDEASGHYRFGEIDWQEFNEVISGRGICNHERLAAKRKAWEEGEWVREAALAHAQKQQARSAA

SEQ ID NO: 13959 - protein, 350 aa, Klebsiella pneumoniae
WRGGQAIMLNGSPGILPGLPAAGWRRISKVTIAGERPGNRLQIRGTVMNNAQTVLVFGATGQQGGSVARALLHRGWRVRALVRDPFSAGAAALAARGAELVVGTFEDRAAMRSAMAGVDGVFSVQPSSPGGTVTDEQEVRYGITIADLAVECGVKHLVYSSGSATGETPTGVAHYDTKAEIERHIRRLPLAATIVRPATFMELLVMPGFGLDEGRFQFFMLPEGRMQVLAVEDIGHLVAAVFAAPARFAGKTFEIASDSVTGRQLEGLFSAAAGRPIPYSRFSDEVLAASPFLHKLTGLVDDGRLAGHADLDALRQLHPQLHTFAGWLAGPGRPAFERALTSGARWAFDR

SEQ ID NO: 13960 - protein, 378 aa, Klebsiella pneumoniae
RNFFMKRKVLALVIPALLAAGAAHAAEIYNKDGNKLDLYGKVDGLHYFSSDSKKDGDQTYLRFGFKGETQINDMLTGYGQWEYNVQANNTETSSDQAWTRLAFAGIKVGDYGSFDYGRNYGVLYDVEGWTDMLPEFGGDSYTYADNFMAGRANGVATYRNSDFFGLVEGLNFALQYQGKNEGQNAQDINVGTNNRSSDSDVRFDNGDGFGLSTSYDFGMGISAAAAYTSSDRTNDQMTQTNARGDKAEAWTAGLKYDANDIYLATMYSETRNMTPYGNDGVANKTQNFEVTAQYQFDFGLRPAISYLQSKGKDLYNNGRYADKDLVKYMDVGATYYFNRNMSTYVDYKINLLDGNDKFYEDNGISTDNIVALGLVYQF

SEQ ID NO: 13961 - protein, 295 aa, Klebsiella pneumoniae
KDLMRDALFDLCRRFADAHVDSSGVAVTLVPGITLVRALHPGDLQAAIARPLVAMLLQGRKSVTTGLASFDYGPGEAMVIAADVPTTSQITEASQRFPYYALVLELDLAILRELQEAGPSGPDEAPRVGIEPMNADVTDAAYRLARLFDQPGALAVLGEGLRRELHYWLLQSVHGPAIRALGAVDSHSARIRRAVAMLRRDFMQPVSVDALADAAGMSVSVFHRHFRAMTTLSPLQFQKQLRLIHARRLMLAEGMSIAQAAGEVGYISVSQFTREYARLYGAPPGRDRRREKMSA

SEQ ID NO: 13962 - protein, 116 aa, Klebsiella pneumoniae
IQLIQIEHGKAIVHRQACGAGGETFSLEVGGDDDLELGPAVHMVDFNQFHQSGFIAIAFDDKAALALIVNMFVVQIGELNEGLVRLFKPVAHDAGVVIELVDEAQIFALKRAEFDV

SEQ ID NO: 13963 - protein, 535 aa, Klebsiella pneumoniae
DGIMSILQSLVAASQLDESVLRQQARSRQAQWQSWLAPISDAQPTGDDPGYDDDFQRIRDEVNKISGVDTELICQLAGQLLATTKDIRIVTYYCWARLHQDGEAGLADGLEVLAGLLQRYGMQLYPQRDRSRKAALEWLAGTRILDSLSLFPEVVREDARRTVGALLLIDDCLTTEPETSRPDLQALWGALESRLIKGGGVDAVVPQNVGNRGLAQTASRMAEYEAPVLSNITSGQDLLAQARTLTAYLRVQPDGWLAAHRLMKSLRHDTLTIIPAPDAEGKTRIEPPRADQRAMLKRLYLQQSWSEILEQADSTFSRGANHLWLDLQWYIHQALVRSGQDVLADIIIADLKGLLRRLTGLETLAFNDGTPFADEVTLNWINQSVLDDMSVWQDEPVSAASGADNDILALEPEALEKADTDGLDAALHWIQTRPGTESTKEKWLLRLLMARVAEQKGKNDLALYLLRELDDAAGSITLTQWIPALLFEIKSRRLRLLRMKATRSESEKLRLQPEMDQLLAGLIALDPASSAVLCG

SEQ ID NO: 13964 - protein, 309 aa, Klebsiella pneumoniae
ATVITKSMAFQIKFHQIRAFVEVAREGSIRGASRALAVSQPALTKAIKELEEGLSAQLFVRRSQGVALTDNGESFYQHASLILEELRAAQDELLQRQGEQAGQINIGLGASVARSLMPSVICRFHQQHPQVKVRIMEGQLLAMINELRQGELDFTINTYYPGPYDHEFSFEKLFEKPFAVFARAGHPAAQATSLGELMDHHWTMPTPRGSYFKQLQECFEQLGREPKVGIVCETFSSCISLVVKSDFLSILPVELGNDPLMADKLVMIPIREVLPTATYYLIQRRDTRQTPLTASLITLFRRQSRQLFP

SEQ ID NO: 13965 - protein, 117 aa, Klebsiella pneumoniae
PEPILILLSDKTTLCATSIDQEATMLQHKIREAFCAFISRNPKGYQYLRTSDFVNSLRRRGIHLSEVEANSWTAREQTYFVDKTPDHCENRLWMMAGMGRGSDGASQGCWRLQSIVL

SEQ ID NO: 13966 - protein, 329 aa, Klebsiella pneumoniae
FFHIPAIAPLPEATQMQQCGNIVITGEGRMMTTAEGGLAYQRWLATINQVCGHFAARPLKESFHGEIDARYAGSLKVSTVTAAGVNLYRTRNEIKRDNDAWFYTVFQLAGEAIIEQDDRQVTLAAGDITLIDAARPCSIVWQQTSRQASLLLPRQRVAPTGDITTACRLDKSLPMVQLSQRLLLESMGGTTLSASESEAALEAIACLLRPVLHQRDPAPSRREKQFQKIIALIDASIQSEHLRPEWLASETGMSVRSLYRLFADQGLVVAQYIKNRRLDLCAQALQNVHDDEKLAGIGYRWGFSDHSHFSTAFKQRFGVTPGEYRKRCR

SEQ ID NO: 13967 - protein, 332 aa, Klebsiella pneumoniae
GEHMAAKGFYLVQGDRTTCGGRITTGAEDHTLFDKPVAREQDSVTCGKHAGLYKIAGGIDNDTIHGRRMAGTLDSCSTCPCKAKFIPSMMNDTYEKGGECITTLFSLDGLMASLQEPYKNLHPENKTERQCTHTDGAIKVAEYILSEIKANVRSDTAETIRYLIDEDFIIKRLTEWNKLPFYARLGPPPKTDLLAAMAIWYQTVKTGSIWDHKPKIRDFFSSVAVARPLPRKGKSSKSYYHKFKQHDYFYDVWSNIHYGYVGRSVGFSEAILLKGSTWEQNMTPGAMGDDTMDDITREGANKQVISSQADSLIKISRIWADFFPANTSNQPI

SEQ ID NO: 13968 - protein, 280 aa, Klebsiella pneumoniae
SFNIANPPGKYLMNKSVARGIALALLSATSFYAAADAHLIRVGFNPGPYKEQFEKGVAPYLLSKGYKIEYKDFSDGIQVNDAVARGDIEANIMQHPVYLKAINERLGIDNVGIVQVPTPPMGLYGGKLTTLGTPAAGTVVSVPNQASNEYRAVLVLESLGWVKIKPDSDPATFSQRNIVDNPYKIVLKEMDNAQQVRALPDVDYGLIQGNFAVSSGMSLTSALKLEAATSHFINVVTVAGKNQKAQFAKDIIDGYHSAEFKKYILSHPQYDGYLLPDYLK

SEQ ID NO: 13969 - protein, 550 aa, Klebsiella pneumoniae
LIDIAVFRRPGKAKAAARQKGAHPNEIRFVIDQRRPEGRRGLLHAAGALRGLDLLEEVIAFIINEDKGREILHFNFPDSLHTQLRIGHALEALDALLGQHCRRAADAAEVEAAVFVAGVGDLLAAVAFRQHDLARPMGLQQINVRVHAACGGRPQRAGGVTVRRLGRTCVVDRVIFDVLRQRLAVVDKLLQLSVGDIAGNDDSPAQRQAGGHRILRQLRQDLAHRLVKIYLHRFAFPGLAQMLRDIFPRVALQLLDPDAVAVNLGFDVAVGGTGNPHPYRAGSAVTRQTDHADIVGKVFPAELRAETKVLRLQQQLLLQLHVAERLAVLVTFGRQAIVVFGGRQLHGLQRRFRRGTADHEGDMVRWTGGSTEGAHLLDEVIFQLRRGDQRFGFLVQVGFVRRAAALGDAEEFVLIAIGSIEIDLRRQVGASVNLFIHIQRRVLRVAQVVLDIGVVHPLRQGGFIAAAGPHALAFFTHDDRGAGVLAGGQNTFGGDIRVAQELQRDVFIVFAGFRIVKDIRHLLLMRRAKHKGGVVESMLRQKGQRLRVNF

SEQ ID NO: 13970 - protein, 67 aa, Klebsiella pneumoniae
FYCIFCCFLVIVYVNKSILIVITHLYYVNAIYYFNNTIEVAMLLLGLNSFITNVIGLVIKKRAILLA

SEQ ID NO: 13971 - protein, 502 aa, Klebsiella pneumoniae
GKGMSTSQIALLASVQQFLDRQHGLYIDGAPCAAQSENRLTVWDPATGQAIATTADASPADVDRAVMSAWRAFVDRRWAGRTPADRERILLRFADLVEQHGEELAQLETLEQGKSIAISRAFEVGCTLNWMRYTAGLTTKISGRTLDVSIPFPQGARYQAWTKKEPVGVVAGIVPWNFPLMIGMWKVMPALAAGCSIVIKPSETTPLTLLRVAELATQAGIPDGVFNVVTGSGAGCGAALTAHPQVAKVSFTGSTATGKQIARVAADRLTRVTLELGGKNPAIVLKDADPQWVIEGLMTGSFLNQGQVCAASSRIYIEAPLFDTLVSGFEQAVKSLQVGPGMQETAQINPVVSRAHCDKVAAYLEEARQQKAELISGSAGPDAGGYYIPPTLVVNPDAGLRLSREEVFGPVVNLVRVADGEEALRLANDSDFGLTASVWTRDLTQALNYTDRLQAGTVWVNSHTLIDANLPFGGMKQSGTGRDFGPDWLDGWCETKSVCVRY

SEQ ID NO: 13972 - protein, 220 aa, Klebsiella pneumoniae
TAFIICVDIAFSSYGNALYLTEHRSEYMERCSDCQGTPMRADARKNYDLLIEVARDVFVEQGAEASLRDIARRAGVGMGTLYRHFPNRDSLLEALLRSRFAALTARAESLLLAADPAAALLEWLAESVAFTHQHRGIIAPLMSAIDDPESALHSACVALRAAGTSLLTRAQQAGLARPDLSGEELFDLIAALAWLREQPSHAPRAERILAVLADAILTAG

SEQ ID NO: 13973 - protein, 577 aa, Klebsiella pneumoniae
LMLIASRRTLISTRTNKTICRIRRLLMNAEQTTGRVWNRRRTEKQRRLAEANMPGKVIPTDQLVSVLENLLAPGDRVVLEGNNQKQADFLSRMLAEVNPQKIHDLHMIMPSVGRSEHLDLFEKGIARKLDFSFSGTQSLRISQLLEDGLLEIGAIHTYIELYSRLYVDLSPNVALIAGYKADRKGNLYTGPSTEDTPALVEAAAFHDGIVIAQVNELVDDECDLPRVDIPGSWIDYVVVADKPFFIEPLFTRDPRLIKQEHILMAMMAIKGIYAEHQVQSLNHGIGFNTAAIELLLPTYGEQLGLKGKICKHWTLNPHPTLIPAIESGWVESVHCFGGELGMEEYIRARPDIFFTGPDGSMRSNRAFCQLAGQYAVDMFIGSTLQVDGLANSSTVTRGRLSGFGGAPNMGHDPHGRRHATPAWLNMITEPDPMQRGKKLVVQMVETFQAGVKPTFVETLDAVEVAKTSGMPLAPVMIYGDDVTHVLTEEGIAYLYRAESLEERRAMVAAVAGITDIGLGVDAKRVAALRQSGKVVYPEDLGIRRSDATRSLLAAGSVADLVEWSDGLYNPPAKFRSW

SEQ ID NO: 13974 - protein, 415 aa, Klebsiella pneumoniae
GKIMKLHEMKQKRNIIAKDMRALHDKIGDTPWTDEQRTQWNAAKSELDALDERIAREEELRRQDQDYIHENEPEQRQQQNRDPANPEAQANERRAAAFNAFLRRGLGEMSAEERQALKELRAQGTTPDEKGGYTVPTQFRNKIVEALKDYGGIASVAQILNTANGQDIDWATSDGTTEEGELLGENTETSEEDVSFGGATLGAKKLSSKIIRVSNELLQDSGVDIEAFLAARIATRIGRGEAKYLVLGTGTGTPLQPKGLAASVTGTKNTAAATTFTWKELNALKHSVDPAYRNGPKVRWAFNDATLQLVEEMEDGQGRPLWLPNIIGGAPATVLQVPYVVDQAIPDIAAGAKFAYFGDFNRFIVRRVTYMTLKRLVERYAEYDQTGFLAFHRFDCVLEDTGAIKALVGKPASGG

SEQ ID NO: 13975 - protein, 341 aa, Klebsiella pneumoniae; identical to SEQ ID NO: 9374

SEQ ID NO: 13976 - protein, 243 aa, Klebsiella pneumoniae
EIPMAEQQPRPILITGAGRRIGLALAHHFLQQRQPVIVSYRTPYPAIDGLREAGALCLQADFSSDDGILTFAEAVKSHTDGLRAIIHNASDWMAEKPGVPLSTVINRMMQIHVHAPYLLNHALEALLRGHGHAASDIIHITDYVVERGSDKHIAYAASKAALDNMTRSFARKLAPEVKVNAIAPSLIMFNEGDDEAYRQQALDKSLMKIAPGEKEISDLIDYLFTSRYVTGRSFAVDGGRPLR

SEQ ID NO: 13977 - protein, 225 aa, Klebsiella pneumoniae
KSPMFDLIDTAITGDQFLLALRDTLIMVAVSLGFGALIGVPLGIVLVVCRPGGIVANPVVHQALNPLINVLRSLPFIILLIVILPFTRLLVGTTIGTAGAIVPLIVFVAPYIARLVESSLLEVDEGILEAADAMGATPLQTVWHFMLPEAAASLILALTTATIGLLGATAMAGTVGGGGIGDLAITYGYQRFDAFATLTTALVLIVIVQLIQTLGTRLARRLRRE

SEQ ID NO: 13978 - protein, 479 aa, Klebsiella pneumoniae
GNTMTEHQHQASPAAGGEGASQLKRGLSARHIQMIALGGAIGTGLFMGAGRNIAVAGTSILVIYVLVGFFTYMVMRAMGELLLTRHDYRSFADFVGEYLGPQASFYLGWTYWLSWVVTCIADVVVCGSYMQYWFPELSAWMPALSMLAILFLLNLLSVKMFGEAEFWFALIKVITIIALIGTGGWMIATGWTSPDGVTASLSHLTDPTAFMPHGITGFFAGFQIAIFSFTGIELLGTMTAETRDPQRILPKAINALPLRIIIFYLLSMVVIIAVASWPGVSAETSPFVTLFAKAGLPAAAAVINFVALTSAMSSANSGVFSSTRMLYGLSVEKHAHWQFRILSRSTRIPVRSLLFSCFCMLIGTLLLFLVPNVMTLFTIVSTLAAIMVVFSWGMILVAYLVYRRQRPDLHAGSIFKMPAGVVMSWVSLLFFAFAIFIMIFDPDTLLALLASPLWFIALWGFWKLKQRREGQLQLDNQSA

SEQ ID NO: 13979 - protein, 263 aa, Klebsiella pneumoniae
DKTMPKFAANLSMLFTELPFLERFAAAARAGFEAVEFLFPYEYAAGEIRQHLQENQLQLVLFNTPPGDVNAGEWGLAAIPGRSAEARRDIELALEYACQLGCPQVHIMAGVVPPGADRADCEAVLIDNLRYAAECFARHDKRILIEALNPQTKPGYLYHSQYQTLAMVKRVDRPNLAVQLDLFHAQKVDGNLSHLITEYAGQYRHIQIASLPDRHEPDEGEINYPWLYALLDKTGYDGWIGCEYIPRTDTLSGLGWFSPYRKK

SEQ ID NO: 13980 - protein, 428 aa, Klebsiella pneumoniae
GQAILILHAERGCSYAAGAIVTTMLTTLIYRSQVHPDRPPVDLDALVHRASSKNLPLGITGILLFNGLQFFQVLEGTEEALESLFSEIQSDPRHRDVVELMRDYSAYRRFHGTGMRILDLRLFETDGALEEILRFSTFGVTEPVNDRMFRLLSAFIADGGRYCLPEPLQPSRWMMMPASGTAAPQHLPGQPCQFALQAIVEPAKKRVSSFEALIRSPTGGSPVEMFAAIAAEDRYRFDLESKAYAFALAGQLPLGKHQLAINLLPGSLYHHPDAVGWLMDSLLAAGLRPDQVLIEVTETEVITCFDQFRKVLKALRVAGMKLAIDDFGAGYSGLSLLTRFQPDKIKVDAELVRDIHISGTKQAIVASVVRCCEDLGITVVAEGVETLEEWCWLQSVGIRLFQGFLFSRPCLNGIGEICWPVARQAMDL

SEQ ID NO: 13981 - protein, 201 aa, Klebsiella pneumoniae
GGCMPIYQIDGLTPVVPEESYVHPTAVLIGDVILGKGVYVGPNASLRGDFGRIVVKDGANIQDNCVMHGFPGQDTVVEEEGHIGHGAILHGCVIGRNALVGMSAVIIDGAVIGENSIVGASAFVKANAEMPANHLIIGSPAKAIRTLSEQELAWKKQGTREYQALVERCKQTLHQVEPLREVEAGRKRLAFDENLRPKAAT

SEQ ID NO: 13982 - protein, 942 aa, Klebsiella pneumoniae
QPLINSFRSNPRLGEHRFGAKNMAFDPPIGSSAPEVLLINAKNFDFAMNDITTAFWKDRFGQERKTWYGIESSLEVMRAAQLAAFISQFNQQAQEFDAQISSQASRYEAVLQEAGRTVLGRYEDGPWTLTNYNQLISYGGTFWKLAASVVIGDGYTTAGNTPVSWNATDRVNFVDVGQDQLRSELGAIFMPAPSGNAVTDTLLLQAALRVGGQIIYNRPGEYLYNTYSVIKSGTSLHTAAGINWKQVAGKSNPFIVNEAFSASRYAVTSMTKNEAAINSYLDGADLKSKNYINVVCENHLFIKGDWAAFHGAKEFAYDGIMRVISIIDANTFIAESHSMPTATTATPDDVFWHGMYCFKADHNIEVDIQGRIDGNWRNNSTASTTDFDERVKFMGMAFWGVQHLTVRINDAFNIRKYTVLFANIRNAYIPRINFYNFSDGIHFQPPYVGVSIGTLAGATGDDMLALTNGDYETYQLSRGHGYSLYADHLMPQNALTAMKVVGATNYRYWDIGIGAISGSTRLHVIAAIRDLALTWTDIGRFYIGSCTCASQTKDDFYLNTDRMDLFAIDNYTVCSPESGTHSITMGNRYGVTTNIGTIKLRNVQYKEGVHLKSFYIGTNCNIGLLDIEFANATPLNGALAGVLTAPAMTYDGDAGESAGGFIDTIRLSGKYVFPQANIGRLAWLRYKWNRIFLDNLYVENGERVIHENEITGNDGKIFCNNVHVRNTHDFCNTYNKVQAYHSSTLLETTDMPYWLRDASAELRIYGAVKTLNDTGVCRVEAGKYYAKGLDVPVNLTDFPPAGNHGDVVFNTNAAGNAVGRYQYNSANSTWELQNRENISQSPSDTSATIYNPDWNRGFNWVQTLTKDVQFTGGAANLAKLNRGDKVRLYLTQDATGGRAVSFSTAYKFPVAWVNGGTTGQHTIGEFVYDGQFLVLERANVWY

SEQ ID NO: 13983 - protein, 266 aa, Klebsiella pneumoniae
RTLIVEAFILSAVEQGVMTITLNRPDRLNSFNDLMHHQLAECLKQAERDDGVRCLLITGAGRGFCAGQDLNDRNVDPSGPPPDLGMSVERFYNPLVRRLAALPKPVICAVNGVAAGAGATLALGCDIVLAARSAKFVMAFSKLGLVPDCGGSWFLPRVAGRARAMGLALLGDSLSAEQAAQWGIIWQLVDDSELADTSLQLARHLAAQPTFGLGLIKKALLASETNSLDAQLDLERDYQRLAGRSDDYREGVSAFLAKRPPQFSGK

SEQ ID NO: 13984 - protein, 411 aa, Klebsiella pneumoniae
GGIMLLDALFRSEPLENPATPITSESAETDNVFAQDVFVSPQTAMKLAAVYACIYVISSNIAQMPLHVMRKTNNKVEAARDHPVFYLVHDEPNMWQTSYKWRELKQRHILGWGNGYTWVKRSRRGEVSGLECCMPWETTLLNTGGRYTYGVYNEEGAFAVNPDDMVHIRALGNNQKMGLSPIMQHAETIGMGMSGQAYTSSFFNGNARPAGIISVKSQLNEESWGRLKSMWQKATAALRSQENKTMLLPAELDYKALTVSPVDAQIIDMSKLNRSMIAGIFNVPAHMINDLEKATFSNITQQAIQFVRYTIMPWVTNWEQELNRRLFTRAELAAGYYVRFNLTGLLRGTPQERAQFYHFAITDGWMSRNEARAFEDMNPVDGLDEMLVSVNAANPADDFKAPKTDEEKPNE

SEQ ID NO: 13985 - protein, 89 aa, Klebsiella pneumoniae
LASMCFRLWSSIATQPEISWPKVSGVASCRWVRPILTISLKATAFSLSVARSACSDGITFSRRAISAATCMAVGNTSFELWLLFTSSLG

SEQ ID NO: 13986 - protein, 549 aa, Klebsiella pneumoniae
KITIILISGASMNRMSIVILWALALLVLQPALAAEPRQQPTAHEQARTVTIFHQPVVMLQATFGQTTPEERVLRTRSALRAFTEDDIRQPLRVVPVIRYGQPGRLFLMNGKPVLLLSQADLDEGDDLTLDQAAQRVLARMEAQRTSLQEQFNNRYLFISAGKALAGALLLALFYYGAFRAWRRVRRFFLLRILEKRSAIPQHWRRYLGNIEVRLYAVLVILLGMLACYLWLSWAFSLFPWTRVWSESLGDWSLGVIRDLSLSIVASLPGLMIVVLIFLLTWLIIRLVKVVLDQVAAGRIQVPGIHPETVSATRRLISVVIWLFALSAAYPFLPGANSLAFKGISVFFGLMLTLGSTGVMTHAMSGLVLIYSRALRKGDWIRLADNEGQVSEIGVLATKILTRENYIVTVPNAVVVSGKIINISAESADGGVNLTTSVTIGYDTPWRQVHALLELAARRTPGIDQQIAPVVRKLGLLDWYTSYELQVRLLPTTKLPDGRNALHSSIIDVFNEFGVQIMSPNFVMQPKAAVVVPQEAWYAAPAVAPQEPEK

SEQ ID NO: 13987 - protein, 344 aa, Klebsiella pneumoniae
LFKMNNAMIEFRHVSKSFSRKGHPVLALQHINLSIERGDIFGIIGYSGAGKSTLLRLINRLETPGEGEVLLNGEPLQDCSGQRLQAIKKDIGMIFQNFNLLNSKTVFHNIAIPLILQGRDKAFIQARVAELLAFVDLSDKIHSYPNELSGGQKQRVGIARALATNPSVLLCDEATSALDPHTTVQILLLLQEINRRYGITIVLITHEMSVIQKICHKVAVMQAGRIVEQGAVFDLFAQPQHPVTASFVQSVVHDRLPQRVASFLQRDNGARALRLEFVGATAQQPIINHLIREYAVEVNILFASMSEVQGRILGFMIVQLLGEPDETERAITHLVDAGVKITHV

SEQ ID NO: 13988 - protein, 690 aa, Klebsiella pneumoniae
PFEIADCKNLCSFAQTLVWAKPLFGAKNMAFNPELGSTSPAVLLDNAERLDKLVNGPAADVPDRGGDPLYSWRQIMAVNQAKQDQLDDIITSLDTASFTFSDTTAGLAGTTDGQYFRVPQGEGDAVGFIYYKNSAGAAVVVASLASAEITKLLGKDDSQKLAAFTDDDGASALALDERGGIFTADSPEDIRKTIGKTGYDRAPAILKITSADKAVHGFMDEFGGVQLPGLQGSVQENIKRLNKRLSEHLERRRVLDARECGLDPFSSEDMWYPLQRATNWLGANGGGTIYIPEGAYRISRPVTPVAGVGYIGAGKKKARLLPFKATAPFLYRGNETYIDNLLFTGFTIDGENQTLNPASGYLPEIKAIFIQYWSNSIIDDMEIVNIGATGLGVDMHYNCLITRCIVENCGRLAEQGALGASGIGIGTGFLNSEPLYVSQNLCRNNKNYGIFYEPQRGVGTAQDIITTDNVCLGNYAGIADCGVEGLIVSNNQMRGNTHGFLMYPGTNNGGKPGRRGRLQGNIIRGNTENGVTSVCSKTDPLLGEYALSGNHIYENGKDGINMNYSYPTVKNLNNVISNNEIYRNGRHGVSLESGDVVNLDIVYNRIYDNGQTTAGHAVNIQVPMSRSSVSNNKLRDTQSTPTQQYPVFATGALTDVDISFNHCVGNAQNTLSLTGAKTRVTTFINPGIDL

SEQ ID NO: 13989 - protein, 320 aa, Klebsiella pneumoniae
PLEIRRFYQRQTPPRADVVYGLACLELLFTFKNLNLLLLSIDIIASPESDMRRDVLLLLCSFYLLPLGAHADDSGLSAKDIKTLFFGHDDRKAVNRPEESPWDAIGQLETASGNLCTATLISPHLALTAGHCLLTPPRGKPDKAVALRFISRKGNWVYEIHGIDGRVDPSLGRRLKADGDGWIVPSAAAPFDFGLIVLRYAPSGITPIPLFPGSKADLTAALKAADRKVTQSGYPEDHLDNLYSHQDCIVTGWAQTSVLSHQCDTLPGDSGSPLLLKTEDGWQVIAVQSSAPGPQDRWRADNRAIAVTGFRDKLEALAGE

SEQ ID NO: 13990 - protein, 453 aa, Klebsiella pneumoniae
GARMSLLTPMLRSSPLTDWFSDAQRVQGMLDFEAALAQAQAACGMVPPEAVGPIVAACRHEAIDFAALGEAAVGAGNLAIPLVKQLTAQVKAQDPEAARYVHWGATSQDAIDTGLVLQLRGALDAAETLLEQLLAALALQADRYRDTVMPGRTWMQHALPVTFGLKLAGTLDALLRWQQRLREVRPRLLALQFGGAAGTLDALKEKGPAVGLALAQILGLSLPDTPWHSQRDRLLEAGAWFAGVCGTLGKFANDFSLLMQTEVAEVGEPVAEGRGGSSTMPHKRNPVACAAILTAAQRTPGLMATLYASQLQQHERALGGWQAEWETLPELITLVGGALAQSEALVRDMQVFPQKMRADLDITHGLIMAEAVTLALAEFIGKAEAHHHIEALCRQALDRHCPLVDLLAADPQVSQYLSRERLTTLLDPATATGSAERFVRQVLARYQEQRDES

SEQ ID NO: 13991 - protein, 269 aa, Klebsiella pneumoniae
GDRMAEQFPPLSAATLAAANQVGAWLAQDDLATLPALPQVDVVVLAGNAVIPTIDAACRLAAAQAVPLLISGGVGHSTGYLYEAVRQDPRYRTLPVDGRPEAHVLADIAHDYWHIPHSRLVVEDQSTNCGENARFTRTTLESRGLAHRRGIVIQDPTMQRRTMATFARVWQGATTPPQWLSFPGCSPVLEQTDGQLGFAGGGAGLWPVTRYLGLLLGELPRLQDTPEGYGPRGKDFISHVTFPPEILDAWRQLREDAQLAGALQARTLG

SEQ ID NO: 13992 - protein, 152 aa, Klebsiella pneumoniae
INGMMMIKPTSKKTGVPRIKATMVKAAMVRFAPSTPVNVFASDSAPPDISISTPSIEPRIIMLAMWPSRPPMPFSMVVIILSAGMPVANATSRLTIRSATKGCAFALITNRSNSTTLANAISNSADVDIGSPRVLTGVQRVIFLENGVYFFR

SEQ ID NO: 13993 - protein, 84 aa, Klebsiella pneumoniae
WLMMSLWDALRMNMMISYQELVRTFPSMKIGFNLFYEHGKFAETLTADNILCVLETTPGAHLPHSRENHWCWNTDNPEKSDESF

SEQ ID NO: 13994 - protein, 337 aa, Klebsiella pneumoniae
SNVFSQQQHQYMVCARQRIIFMKLKNTLLASALLTTATLSAHAATELTPEQAAALKPYDRVVVTGRFNAIGDAVQAVSRKADKDGAASFYVVDTSDYGNGGNWRVTADLYKEDAPKADAPKNRIINGVMELPKDQAVELMPYDTVTVQGFYRSQPEVNDAITKAAKAKGAYAFFIVRQVDANQGGNQRITAYIYKKDAEKRVLQSPDAIPADSEAGRAALAKGGEAAKNVEIPGVATTAAVGSGTGVGRFFETQSSKGGRYTVTLPNGTKVEEVNKVTAAQMVPFDNIQFTGNYGNMTEISYQTAKRAAKKGAKYYHITRQWQERGGNITISADLYK

SEQ ID NO: 13995 - protein, 169 aa, Klebsiella pneumoniae
EFSIMPGPPKTPTHLALVKGNPSKRPINKNEPKPPSGVPPIPKHFDKQGKYWFKRIGEELDAVGVLTTLDAKALELLIEAYVEYRHHCDTLEREGYTYAVYSEDDSDEGGEREIRMIKPHPAAVMKADAWKRIRAMLSEFGMTPASRSKVGAKVPAEADPLEEFLKKRK

SEQ ID NO: 13996 - protein, 80 aa, Klebsiella pneumoniae
SIALEYHICVIRALFKKSEHRIRYIALSLWRDCEYSVNKHQGIDPSITLKKGNTHEQSISSEIQYSGRVLTIWSAFRLFC

SEQ ID NO: 13997 - protein, 430 aa, Klebsiella pneumoniae
GTTMAIETLAARTGATPLRIRRVQKITLTMLFIAGIVNFLDRSSLSVAGEAIRADLGLSATEFGVLLSAFSLSYGFAQLPSGILLDRLGPRIVLGAGLIFWSAMQALTGMVNSFSHFILLRIGLGIGEAPFMPAGVKSINDWYAQRERGTAVGIFNSSTVLGQAIAPPALVIMQLAWGWRTMFVVIGLAGIVVGLCWYVGYRNRRQFTLQEEEQQYLASEEAARPALKFSEWLALFKRRTTWGMILGFSGVNYTGWLYIAWLPGYLQAQQGLSLARTGWVAAIPFLAAAVGMWVNGLVVDALARRGYDQAKTRKTAIVIGLVLSALGTLLVVQSSTPAQAVAFISMALFCVHFAGTSAWGLVQVMVAEHKVASVAAIQNFGSFVFASFAPIVTGWVVDTTHSFNLALVIAAGVTFAGALCYFFIVKTRID

SEQ ID NO: 13998 - protein, 450 aa, Klebsiella pneumoniae
VRTMMKTERPLWGRGIMVSPQHFQQQAAYTAWTAEVIARMGLNHPWGVVEATFEPEMLKLGRLQAHRLQVRFQDGTMIDTDNADALPSALSLDGASGVAVIVLALPLMQANGGNCLKPEEVAERPVRFRQRWRDVRNQFGDDTRQIAVIQPELTLRFAHQDNSDYLTCPLVRLQRDSQGAWLIDETFLPPLLQIQGSRWLATQLEQLLVQLRARLTRLMAMRRESNERMADFAVADVSLFWLLNALNSAEPVLGYFLRYRQSPPERLYPELARLAGSLLTFSLTHQANAVPIYQHDQLNAVFPPLFDLLSDLLEASLPSRVVAIALEHDVRLHFWQARLHDARLREGADYYLSVRSSVPVAQLQEQFPRQCKVGSPDHVKAIVNSSRTGVPLTPLRHVPAAIPLRLENQYFSLDVSHPLATEMLQSGTCMFYVPGMLGEPELELFAVLRT

SEQ ID NO: 13999 - protein, 327 aa, Klebsiella pneumoniae
VDAIKGSELQIPDAIFAWVLDGQGGVKPLADDDIIDKDKPCWLHLNYTHSDSADWLAATPLLPNNVRDALAGESTRPRVTRIGDGALITLRCINGSTDERPDQLVAMRLYMDERLIVSTRQRKVLALDDVLGDLKEGNGPTDGGSWLVEVCDALTDHASEFIEQLHDRIIDLEDDLLDQQVPPRGFLALLRKQLIVMRRYMAPQRDVYARLASERLPWMSDDQRRRMQDIAERLGRGLDEIDSCIARTAIMSDEIAQIMQESLARRTYTMSLMAMVFLPSTFLTGLFGVNLGGIPGNSWHLGFSLFCLMLVVVIGGVAWWLHRSKWL

SEQ ID NO: 14000 - protein, 422 aa, Klebsiella pneumoniae
DLQMLPAGQRYPLRRADQQYRFFEVCQLLLQQGNLRLEIGRVRGRLLRVTGDGHHLLPGFGQIADRRLHIQHLPPGLRLSVRADKYPFLCPDSAPAVGSQLKAFAARPPVTVHQVPQIQLALTAVLRRELDMLFSALVVEADFVVGRGAQDVTFVIADGDVVAVRRVVQHARDIRPVGVTILKANRHLRPRQQRQVQTVGVSGIRPRLADPQALEPGFPARPVKQHIHPVAPVFVDMPVGVVFPGAGHAGRQRPGHHRTRAGLRPVADVRAVRYAGKLHRKVGIAPGVAVHRRDEHAISKLPGHLLSAGDLQHLSRAERRAAGGGLHPGLAVQITLMAKPGVKRPGLRRRMAVMDIPRGQVVISPVVSLTKGGGLPAGDIHLRVHVRRRLAVVVVAGTDLLLHDAVAACHLPHPVHPGRLLP

SEQ ID NO: 14001 - protein, 83 aa, Klebsiella pneumoniae
RAEIAFNWSTISAWRSPTPASSGASRWASTALATVAASGLPPKVVPWVPGWKTCAQASFASIAPIGKPPPSPLALVRMSGTTL

SEQ ID NO: 14002 - protein, 94 aa, Klebsiella pneumoniae
EVWINPLDAEKRGIKNGDMVRVFNQRGEVRLPAKVTPRIMPGVSAMGQGAWHDANMTGDRIDHGACMNTLTTHRPSPLAKGNPQHTNLVDIEKV

SEQ ID NO: 14003 - protein, 62 aa, Klebsiella pneumoniae
RSVLADAEYDRTQCLYITLYFPDLLKIISCYFSEQWLVFHRNNGIVKLLKKNFLCKRSTGHV

SEQ ID NO: 14004 - protein, 310 aa, Klebsiella pneumoniae
MEVVMSSSLTASMQARRHPETTHIDRLATADMLAMLHQDDKQISEAVGACLPDIARLIDIATATISRGGRLVIIGAGASGRTAIEAVSDYSPEGKHALVGLIAGGQTTAMAERETAANNYDLGAFELQSLDFSNRDMLLALTVSGKTPWVWGAMRHAWSLGAPIAVITQQPTSEAAQLADIIIAPQTGPEAVAGLANPKAQLAQRQIVNMLTTGLAIRDGRVYSNLRVDVQADNSHWAERQIAIVMAATDCTRSEAKAALASCHQHCRTAILMLLSGLDAWHARELLTKHHDHLRLALREAQRSAVTPAQ

SEQ ID NO: 14005 - protein, 327 aa, Klebsiella pneumoniae
PRSVVKISGGQEYRMYAVLMKQMLYLKMLAWLEDNIYCNPAIDDLAQYMGYSRRFVYDVFYQYGQLPIGQYIRLRRLTIAAVSLRLTRQPIAAIAWQLSYDSPQTFSREFKKRFSLSPREYRCAAHWDTAKLLKKFHPDGESLPLARFFSLPEQVYYGYPMKYELRLSDLVLQSTAKTSIRQKVDRFFTAGGGSLSVLSDYAAASKNELNVEVNAFVGCHEAGKLPPALAMNSSLTTRSGLYVGVEFYGSWSRYARLSSDLYMELLPSLGVSRRDGYDIECFITRHAEGEEAGDRRYRVRYFIPVTLSAAGLRSESGSGSGPVPGRS

SEQ ID NO: 14006 - protein, 67 aa, Klebsiella pneumoniae
SSDFGPKGCDIAPGINHGSRCRVLFFDGFLQGDPVTQFSGLHITPWVSHSDRFAALAPLRDRRQATG

SEQ ID NO: 14007 - protein, 188 aa, Klebsiella pneumoniae
HCHVQRGLTMADGVEVNLTGLDSVLGKLDAVSQVTRDKSGRAALRKAANVIRDRARTNAARVDDPLTKEAIYKNIVVSFSSKAFRRTGDPTFRVGVMGGARQYANTKANVRKGRAGQSYNTAGDKGNPGGDTWYWRFLELGTEHAAAQPILRPAVNGVDTEVINVFAVELEKSIDRAVRRAAKKGTPV

SEQ ID NO: 14008 - protein, 395 aa, Klebsiella pneumoniae
TGNVMPDFTASPLVDALEENLFSLLEKLAAEVNTEALPLIDLSSGSPDQPTPPEVIDSLQSAIHRRENHGYPSFWGKPQVREAIARFYRRQYDVELDPHSEVAVFQGSHIGIGGIPRALLSPGQYLISTDPCYPIYRSAALQSQAAFYGLPLRAENHFLPDFNDLPREVADKAGLVVLNYPHNPTGALATPALFASALQFARRHQVPILHDFAYAAIGSAASDAPLSLFSQPDAKAWGVETYTFSKTFNMAGWRFGFAVGNASIIRAFKKLHTHSYSTVFGAIQDAAIAALNLPAERIAQLTAVYHQRREWVLRRLAALRWPARDAQGTFFLWLGVPPGYRSQEFARLLLQEAHILVAPGTGFGEGGEGFIRISLTAGDEALSNALDRLARLALF

SEQ ID NO: 14009 - protein, 75 aa, Klebsiella pneumoniae
TLFVVSPAGSPLISGNKNHSLPSRAKKTGKTFTFPLSGPQALAKRTDCQLTNQGDRAKPGGVSSHRVALPTGEYP

SEQ ID NO: 14010 - protein, 196 aa, Klebsiella pneumoniae
SLSVLTTGISMTDALHVKLRPLEREDLRFVHQLDNNASVMRYWFEEPYEAFVELSDLYDKHIHDQSERRFVIECNGDKAGLVELVEINHVHRRAEFQIIISPDFQGKGLATRAARLAMDYGFTVLNLYKLYLIVDKENEKAIHIYRKLGFMVEGELIHEFFINGEYRNTIRMCLFQHQYLAEHKTPGPSLLKPTAQ

SEQ ID NO: 14011 - protein, 583 aa, Klebsiella pneumoniae
MATVADGFRYAERVVSGDIVAGELVRLACQRFFHDLEHGPARGVYFDEGRAQHVLDFYNFVPHVKGHLTGKPIELMDWHVFILINLFGFVVPLIDEITCEGVLDDDGEPMFVRRFRTAYDEVARKNAKSTLSSGIGLYMAGADGEGGAEVYSAATTRDQARIVFDDAKRMIKLAPKTLGRLFGSNKLNIHQERTGSKFEPVASDANNLDGLNIHCGIVDELHAHKTRDVWEVLETATGARLQSLIFAITTAGFNKEGICYEQRDYAIKLLKNFDNPDPLSPKDDSYFALIYTLDEGDDPFDEANWPKANPGLGVCKRWDDMRRLAKKAKEQVAARVGFFTKHLNIWVQGEKAWMDMSRWEKCRDTWDDSTTASWSMWLGVDLSNKIDISAAVKVWLAPNGDVYARSRFWIPEGRLEACTKQQAELYRKWNQAGYLEFTDGDVIDHAVIKEETIEWARGESLNEFAYDPWSATQFALSVAAEGIPIVEVPQTVKNLSEAMKEVEAKIYAGRFHHDGNPVMTWMMSNVTVKPDKNENIFPNKATPENKIDGPVAMFIAMSRLLVNGGGEVDFLSTIDPDEDLLLL

SEQ ID NO: 14012 - protein, 543 aa, Klebsiella pneumoniae
RGNVLFTPGATLAPEQQAALRTLNTEAATLQSQFQQRLLGAAKSGGLVVDYRHQLAGLSDEEIAAAADAARERGLSDRWLLTLTNTTQQPQLLALRDRQTRENLFAAGWTRNQQGDEHDTRDLVLRLAAIRAQQAELLGAADYASWALTDQMAASPAEALGFMRRIAPAARARAERELADIQQVIDNEGGGFRATAWDWLYYSEQVRRAAYAIDDAQLKPYFALERVLQDGVFWTASQLFGLRFVERFDIPVYHLDVRVWEIFDHNGEGMALFYGDYYARDSKSGGAWMDVFVEQSTLRAQRPVIYNVCNYVRPQAGQSALLSWDEVITLFHEFGHTLHGLFASQRYASLSGTNTPRDFVEFPSQIFEHWASQPQVFAHYAKHYQSGEPMPQALRDNMLRAATFNKGYDMSELLAAALLDMRWHSLSTSALPEEVDAFEQLVLREENLDLAAVPPRYRSSYFSHIFGGGYAAGYYAYLWTQMLADDGYQWFVEQGGLTRENGQRFREAILSRGNSTDLAELYRQWRGHDPQIEPMLKNRGLSA

SEQ ID NO: 14013 - protein, 476 aa, Klebsiella pneumoniae
FPRVIKKVTDMATLVKSTSKFMGRKAVAADAPLPDNALMYLDFENGQFIRRTATGAVIRSNSITDVMSFTRATVATYFGDDGLLKYAAAGEPVIEYDQNTLACLGFRPEVQATNRVINSQNFLAANWSKTGIEVTDNDAVSPDGNKTASKIIEAAGAANTVHSLATTVTYAAVVGQPYTFSIFAKANSGSVMQIALPAGVVASAQFANFDLVNGKITRSSPLVMQANMEKCPNGWYRCSLTINPVTAGEPGFTVCLTGGNTAAEALPAYSATTVASIYIWGAQAERAAGYTSYIPTAGAEASRDADILTTPSGYTLIDSAKGAFFVSVVHPHSLKLLSTAYASLACAVVLDNAVEGAHYRLAWRGRDNMNGQAAFAELNAAGGTTVSVNLPPLMAVSDSEQAAFCMFSTGDLSMKAFDGQVWNSASPTIMPAALSRICLGRSYIGASNWFNGHIKKFVYWADNISQPEAEKYFSVL

SEQ ID NO: 14014 - protein, 82 aa, Klebsiella pneumoniae
SWPVSACPRTSIMHHHPVKSSRIISVAYDDASATLEIYFYHQPPLQYTGVPPRIFHDFLQVVSKGRYYDGVIKGKFPERKLR

SEQ ID NO: 14015 - protein, 381 aa, Klebsiella pneumoniae
SSLVPAAISALTGSTAGAKPNPSACATSPPSGKAKGFSRRAACRPPVFLATVEGNLCLIWAVNHQEVFGMTAFPKVALIGPGAIGTTIAAALFERGRAPMVCGRTAHSALVLRTDEGEIVVPGPVYTDPMAIAAPFDLVFVAVKTTQTEAIAPWLTALCSPDTVVCVLQNGVEQRQQFAPLTGGATVLPSVVWFPAQRDADASVWLRAAPRLTLPDLPGAERVQQALAGTRCAVDLAADFTTVAWRKLLQNAVAGLMVLTGRRAGMFAREDITALGLAYLRECLQVARAEGAALSENVPEEIIAGFHRAPADLSTSILIDRLNGRPLEWDIRNGVVQASRASARHSDAAQRYHRAAAGGGQRRPGLTRAGAGASHWKRDLL

SEQ ID NO: 14016 - protein, 71 aa, Klebsiella pneumoniae
FQAVNTSVLLVLFPQKVASCATKFMYQNVLNSVNNAAIHPWDYSWFVSIMPKNNTFTHQIFTGIRTSLRLS

SEQ ID NO: 14017 - protein, 664 aa, Klebsiella pneumoniae
RLQVAVALVLFGDKAVGPGKGRNIEALRTGGEQRPWSLSDLAPRDMAVFAPGHVHMNFVANHPDAMFLTQGRHGLQLLATPDFPRWVVRAAQQQQGILWLRQRRLQALHIAAPPIILQDQWHRGNPPPVSGDGVIERIVGRGVDHDAVAFFRPLADGFRHHIDNRRSVDHRLRIDVAVKAAGVPVGNRPEKRLVAPAAVAEHPVGQPLADGVENTGRGGEIHIGNSERQQIGGAKPVGDIVPLRAPGAVAIDRGGKIKHWSFLSERPLRSGGGLVGSGLHGIHQRGHLIFYRLYLRANNHLQIMLVELYHPDGAMGFQRGGVHFAHIVHRQAQTGNAVIQRNNVLCAAERRQNRRYVIPGFADGTGDGFLHAGGSVDVAARRFQIEAGDGEAEDGIVDREPDSRHYRHQIPLGRQAMQNAKHHEVDDIAVGVADGYPEHRHDGKAETGQQRVDDIQDWRDKQEQELQRLGGAADHAGDDPGDQQAFNFMSVFRTGAVVHRQRGTRQAAEECRHFTLRQETGGAFGEAVGRRTAQLRLEDGQRAADAVAADVEGAAGFGKADQRHQNMVQAKRQQQSLAGAEDHRPKIPGAVDHLPEGVDPHSEDWPHQRDRQPNQPQHHGGDDRHEAGAAEEGQGVRQANVMEAFMQQPDDNPGDHRPEDPGID

SEQ ID NO: 14018 - protein, 472 aa, Klebsiella pneumoniae
VAQVIFGIGVVNALRQSGFIAAAGPDALAFFPHNDGGAGILAGRQHALGGNFRVAQELQGDIFIVIAGFRVEQNRADLLLMGDAQHKGGVVEGLLSEQGQRLRLYFQDLLAVKFGDGDVLFAEQIVFRIVVRQRKRILINKRFSRHSHLLHKDKNRRGSPGGYESEHHGHPRIANQQQGGQEDGAKDGAEAPVIFGRQVAAAVVDWAWASTVRGDDPHHAQRGDHQQDKHFHIHSRDSRGNGQHGRQQRGGVRGGAGKQIVQQVERQQQDDGRHPRGDAAHQRAALFTQPGDKAGGGEAVGQCHQGGEPDKGVPCRFVVGDIAPGEHAGPQHQHDNQQGSQRRFDPVGGEDPHHQREADEYQQQNFIARQFAQFFQFTRGPQWHFVIDFHFRRVEPVGQQRHGQNQQDTQRQEGDEPGAPGDIDANNAFDQRQGQQVRGQSRQEHRAGNTGGGDRYPHQIGTDFTCARIVWL

SEQ ID NO: 14019 - protein, 252 aa, Klebsiella pneumoniae
TIVFANMIGCTQKESSVKRLYWLIPAALLLTACDRKSAPDAFTPEMASFSNEFEFDPLRGPVKDFSQTLLDEHDVVVKKVSAQLSREGCFDLLTLEDVENKTGATLLLDANYYVDGRTHEKRLRLQGKCQLAEMPAAGVSWETDDNGFIISARGKETTATYRYDSDGYPLGKTTTAKEERFTVASTPSKDPRKKLDYTAISTFNDRTLGTVRQTCDYDDHDNPLSCELQVIDESVQPPLTRHYTIKNRIDYY

SEQ ID NO: 14020 - protein, 111 aa, Klebsiella pneumoniae
QIQLFTPVLLCLNLDNIDKERKMKLSLCTGAALLLCSTAVLAAPDSCERVKSDIQQKIINNGVPETAFSLAIVPNDQADQPGVQVVGHCANDTFKITYTRNSDSPAENDAQ

SEQ ID NO: 14021 - protein, 137 aa, Klebsiella pneumoniae
MSKLSMRSISRSIRMWKTCSNPAAICSEATMRKRLLTAALTLALLSAPALALTLSEARQQGRVGETLNGYLAPLRQDKETLALVKQINAARSESYQQLADDNNLPVDEVAKMAGQKLVARAQPGEYVQGLNGQWLRK

SEQ ID NO: 14022 - protein, 473 aa, Klebsiella pneumoniae
TPFSKKITLCTPVNTRGEPMSTSALLLIALASVVLLLLLVIKAKAHPFVALLIVSLLVAFATGIPADKIITTIEKGMGGLLGHIASIIILGSMLGVLIEMSGGAESLAKTLTGVLGAKRTIAALTIVAFILGTPVFFEVGFIIIIPLIYGFSKVAHVSPLKFGLPMAGVMLTVHVALPTHPGAAAAAGILHSDVGWLMLAGIGVSVVVGIVGYFVARFINRRHYHLSINVLEQQQTAEVPDLSVNAQQTRLPPPNALVIGGLIVVPIMLIVSGTLCQALLLPENAVRQLMTVIGTPPVALLISLGLASWTLGIRRRMSLKKLGEVTGSAIPSSADVILVAGAGGAFGGVLVASGIGNALAEALETIHLPLMPAAFLLSLVLRASQGSATVAILTTSGLLSQAVVGLEPLQLVLVTLATCFGSLGLSHVNDAGFWVVTRYLGLSVPDGLKTWTVLTTIMGVTGFLITWLLWFAL

SEQ ID NO: 14023 - protein, 125 aa, Klebsiella pneumoniae
PHLSPPGRLAPPGGFSILPALNGSQFCQNGGEGVINLIAGEQFFTQREASAAGTDQQPDFRIIIAAFNYGNIPQGNNVGIGIEPRRKYHRLAAHANHHPILQTIAIAQRNNTGGNKYSAYPHANH

SEQ ID NO: 14024 - protein, 79 aa, Klebsiella pneumoniae
SLLSPRFIEEETMKTYDRNRNAIATGSMVMIAGNGTTGVIKAIHGEGKTAEQLRRADCVEIDGCEGRFCPLDLIRLGFH

SEQ ID NO: 14025 - protein, 1032 aa, Klebsiella pneumoniae
TPVSESGVLPVTIRLYPSRLPGEPLETHEHRDTTIHDWMLQHVDNYRNDMVQRVTFEVNGKPVPPAEWPLCFISAESDVKVYPIPGEGVTATTIAAWAAAAIAAASAVYVLITMSNMDKGGYSSSSGLGLDLNPAKANQAKLGDPIREVFGRCRIYPDYVVQPVTRFNPDDPTRMTVEMMVCLGKGNFAFTNGDLRVGSTPISALGDSFSYNVYSPGADVSGDRRSENWFNSTEVGGTSSGSGLDMAQTSPDSTDINADSMTVSGASVTFNGLDDGNDDDDEGNALPESWVEGAIVTIVAPMNFLVSTSSGYSVLASNSLGEINPYPGMPVTLEINGTEYELVIATYTAKQDAIPGVGGNAASLKANASPSTYDYSGTGQTFTITWQGHEYTISLVADYVNMPGLLAVINDGLTGSGLLAQDSGGVVLIAEASSPWLGGNITSSSLPVAVFGDSPVFTSGTASSGGSPAITANVTLAYGSATGVAFSGIPEGTQRLALAHRGNEYRIADADGTTATVQRLIEGVVDPSWSGFSPRTMIDYQATGISDNNTWMGPFLACPESEVVDAFEVNFSFPSGICGFDSKGKKRIRHCEWEIQYRVYGSGSGWTSRQGVYALKNINGLGFTERFDLSSPGLVEVRCRRRNEQGSNNARDSMYWQALRGRLLARPTSYAGVTLMGVTVETGGKLAAQSDRRVNVVATRIYDSGVARSISGALYHVGRSLGMEMDTEAIDALEQTYWTPNGEYFDFATGDSISALEMLQKIAAAGKSYFLLNTQSVASVGREGVKPWTGAITPHEMVSEMQTDFVTVTDDDYDGVDVTYINGSTWAEETVQCRLPGNPTPLKIEAYRADGVGNPDHAYQIGMRRLRKYQLQRMTHKTTTELDALCYNVGDRIVLTDDIPGSNTISCLIESMATAGGVTTFDVSEPLDWTFANPRVYLRYQDGKASRLFEASPTGDNYQVSVPYQSEFADILLDDPIIEPPRLIFCSSESDLYHAIVSEIVPQDDGTCEITARQYRAEFYDYDDATYPGDVA

SEQ ID NO: 14026 - protein, 116 aa, Klebsiella pneumoniae
IRTSPLDAARHAAYYSGVCFFKTFLRGERMRAAMLVGCAALLLSACSSEPVQQATAAHVTPGMRAAMSDAGQANCAMIGGSLSVARQLDGSAIGMCALPNGKRCSEQALAGGSCGY

SEQ ID NO: 14027 - protein, 387 aa, Klebsiella pneumoniae
LANSVPRPAKRSIAATAAGNLLITLNVFEVAMTTFYSLKVARVEPETRDAVTITFAIPQALQAEYCFRPGQHLTLKARLGGEELRRCYSICHSRTPGEISVAVKAIDGGRFSRYAQHDIQQGMELEVMVPQGHFGYQPQAERQGEYLAIAAGSGITPMMAIISATLATEPQSRFTLIYGNRSSHSMMFRQALADLKDRYPQRLQVIHLFSQESMDSDLLQGRIDGDKLRQLADHLLDFSRFDEAFICGPAVMMDEAEATLRELGVAEKSIHLERFNTPGGNVKRAAGVQAEGRTVTIRQDGRDRLIALSAEDDSILDAALRQGADLPFACKGGVCATCKCKVLRGEVAMAANYSLEADELAAGYVLSCQSLPTSGDVVVDFDARGIA

SEQ ID NO: 14028 - protein, 121 aa, Klebsiella pneumoniae
LIDSLLRHTGMGLLIKGLLGALVVVLIGVLAKTKNYAIAGLVPLFPTFALIAHYIVASERGIEALRATIVFGMWSILPYFIYLLSLWYFTGIMRLPLALAGAVGCWGLCAWLLILGWGRFH

SEQ ID NO: 14029 - protein, 329 aa, Klebsiella pneumoniae
PCESGVRKMTTQAVSGRRYFTKAWLMEQKSLIALLVLIAVVSTMSPNFFTVNNLFNILQQTSVNAIMAVGMTLVILTSGIDLSVGSLLALTGAVAASIVGIEVNALVAVAAALALGAAIGAVTGVIVARGRVQAFIATLVMMLLLRGVTMVYTNGSPINTGFSDNADLFGWFGIGRPLGIPTPVWIMAIVFLAAWYMLHHTRLGRYIYALGGNEAATRLSGISVNKVKIIVYALCGMLASLAGIIEVARLSSAQPTAGTGYELDAIAAVVLGGTSLAGGKGRIVGTLIGALILGFLNNGLNLLGVSSYYQMIVKAVVILLAVLVDNKKQ

SEQ ID NO: 14030 - protein, 165 aa, Klebsiella pneumoniae
SKGSDLAFCPSIEDKVMRFADRNQHQIFLEPEGLTSNEIYPNGISTSLPFDVQMQIVRSMQGMENARIVRPGYAIEYDFFDPRDLKPTLESKFIQGLFFAGQINGTTGYEEAAGQGLLPGLKPPRFFGKKKAGRRRPNKLTLALLGDDLWPLGYKRTVPDCYFPP

SEQ ID NO: 14031 - protein, 100 aa, Klebsiella pneumoniae
NPRPGLQSIFIPLYARQTTMFYQDPFDVIIIGGGHASTEAAMAAARMGQQNPAFDTQYRHAGANELQPGDWRHWERTPGKRSGCARRFDGQSDRSGGYSV

SEQ ID NO: 14032 - protein, 331 aa, Klebsiella pneumoniae
CLATMKDVARIAGVSTSTVSHVINKDRFVSEAITAKVDAAIKSLNYAPSALARSLKLNQTRTIGMLITASTNPFYSELVRGVERSCFERGYSLVLCNTEGDEQRMNRNLETLMQKRVDGLLLLCTETHQPSPEIMQRYPSVPTVMMDWAPFDGDSDLIQDNSLLGGDMATQYLIDQGHSRIACIAGPLDKTPARLRLEGYHAAMARCGLPVAEGYVVTSDFEFGGGFSAMQQLLALPQRPQAVFVGNDAMAVGAYQALYQAGLQIPQDMALVGYDDIELARYMTPPLTTIHQPKDELGELAIDVLIHRMADPQQKQQRVQLTPELVVRGSA

SEQ ID NO: 14033 - protein, 623 aa, Klebsiella pneumoniae
SMSTDNKQSLPALTLAAIGVVYGDIGTSPLYTLRECLSGQFGFGVERDAVFGFLSLIFWLLIFTVSIKYITFVMRADNAGEGGILTLMSLAGRNTSARMTSVLVILGLIGGSFFYGEVVITPAISVMSAIEGLEIIAPQLDTWIVPISIIVLTLLFVIQKHGTGMVGKLFAPIMLIWFLLLAVLGARSIYANPEVLQALNPYWAVHFFLQYKTVSFIALGAVVLSITGVEALYADMGHFGKLPIRVAWFSVVLPSLVLNYFGQGALLLKHPEAIKNPFFLLAPEWALIPMLIIATLATVIASQAVISGVFSLTRQAVRLGYLSPMRIIHTSEMESGQIYIPFINWLLYVSVVIVIVSFEHSSNLAAAYGIAVTGTMVLTSILSATVARKNWHWNKLFVGLMLVAFLCIDIPLFSANLDKIVSGGWLPLSLGMVMFTVMTTWKSERFRLLRRMHEHGNSLEAMISSLEKSPPVRVPGTAVYMSRALNVIPFALLHNLKHNKVLHERVILLTLRTEDAPYVHNVRRVQIEQLSPSFWRVVASYGWRETPNVEEVFHRCGLEGLSCRMMETSFFMSHESLIIGKRPWYLRLRGKLYLLLQRNALRAPDQFEIPPNRVIELGTQVEI

SEQ ID NO: 14034 - protein, 487 aa, Klebsiella pneumoniae
TGEAAMTLDMLNVMLAVSEEGMIEEMLLALLASPQLAVFFEKFPRLKNIIAADIPRWREAVRARLKEVNIPPDLDAEVQTYQQAQLLSTSQFIVQLPQILGKLHQLQSPFAAQAQKLVDDNATFTPALHTLFLQRWRLSLVVQATSLNQQLLDEERDQLLSEVQERMTLSGQLDPVLAENDTAAGRLWDMSAGELKRGDYQLIVRYGDFLNQQPELLQLAEQLGRSREAKSVPKKDAPMETFRSLVRKPATVPEQVDGLQQSDDILRLLPPELATLGITELEFEFYRKLVEKQLLTYRLHGDAWREKITERPVTRQDFDEQPRGPFIVCVDTSGSMGGFNEQCAKAFCLALMRIALADNRRCFIMLFSSEVVHYELTSESGLEQAIRFLSQRFRGGTDLASCFRAIIERLQNPQWVDADAVVISDFIAQRLPDEVIAQVGELQRKHQHRFHAVAMSVHGKPGIMRIFDHIWRFDTGLRSRLLRRWRR

SEQ ID NO: 14035 - protein, 363 aa, Klebsiella pneumoniae
NRSLYKDLLFNTQDPGVFLERRKLSRIHGPGFNPFSYRFMRGRPPCFIRILLTSLSLAGVMQALRPQWPQRVWVNKTLLLTHNIDTLGQMSCNPAIGGIGKGHLVKEVDALGGLMAKAIDQAGIQFRILNASKGPAVRATRAQADRVLYRQAVRTALENQPNLMIFQQAVEDLIVENDRVVGAVTQMGLKFRAKAVVLTVGTFLDGKIHIGLDNYSGGRAGDPPSIPLSRRLRELPLRVSRLKTGTPPRIDARTIDFSVLAQQHGDNPMPVFSFMGSADQHPRQVPCYITHTNEKTHDVIRNNLDRSPMYAGVIEGIGPRFLPVDRRQSHALCRSQPASDLPRAGRTDLKRNLSERYIHQPTV

SEQ ID NO: 14036 - protein, 305 aa, Klebsiella pneumoniae
LRTLQDILTMNMKKLATLVSAVALSATVSANAMAKDTIALVISTLNNPFFVSLKDGAQKEADKLGYNLVVLDSQNNPAKELANVQDLTVRGTKLLLINPTDSDAVGNAVKMANQAKIPVITLDRQATKGDVVSHIASDNVQGGKMAGDYIAKKVGESAKVIELQGIAGTSAARERGEGFKQAVAAHKFNVLASQPADFDRTKGLNVMQNLLTAHPDVQAVFAQNDEMALGALRALQTAGKSDVMVVGFDGTPDGEKAVNSGKLAATVAQLPEQIGAKGVETADKVLKGEKVEANYPVELKLVVKQ

SEQ ID NO: 14037 - protein, 242 aa, Klebsiella pneumoniae
SRGKKGTAFMSLSAQQLAAQKNISWVLAEKLAQKILTGEYQPESILPGEMELGEQFGVSRTAVREAVKTLTAKGMLLPRPRIGTRVMPRSSWNFLDKELLSWWLTEDNFEEVVSHFLVMRSSLEPQACFLAAANGTAGQKAQLNTLMEEMIALKRHFQRERWIEVDMAWHEHIYEMSGNPFLSSFASLFHSVYHTYFTSITQNEVVKLDLHQAIVDAILNSDAPGALLACQALLNAPHHVNQ

SEQ ID NO: 14038 - protein, 87 aa, Klebsiella pneumoniae
RNVWETALWEGDNSWKRELKPDNAEEPKGGPWALCHIMGPKGLAVGGERSPRRQTLLGWKGTTPLEREHGQTLREARAGNFSKGPTL

SEQ ID NO: 14039 - protein, 351 aa, Klebsiella pneumoniae
LLYCRPVLLLNQWQQDAGVIKMKTAYIAKQRQISFVKSHFSRQLEEKLGLIEVQAPILSRVGDGTQDNLSGCEKAVQVKVKTLPDAQFEVVHSLAKWKRQTLGQHDFSAGEGLYTHMKALRPDEDRLTPIHSVYVDQWDWERVMGDEERHVGTLKATVEAIYAGIKATELAVSQEFGLTPFLPEQIHFVHSQELLSRYPELDAKGRERAIAKELGAVFLIGIGGKLADGKRHDVRAPDYDDWSTEVSEGFAGLNGDILVWNPVLEDAFEISSMGIRVDAEALKRQLALTGDEDRLKLEWHQALLRGEMPQTIGGGIGQSRLTMLLLQLDHIGQVQCGVWPAQVRESVSALL

SEQ ID NO: 14040 - protein, 165 aa, Klebsiella pneumoniae
IPARSQRTIRHSEQLSGRSMADITLISGSTLGSAEYVAEHLAEKLEEAGYSTEIQHGPLVDDLQAQGIWLIISSTHGAGDIPDNLVPFYDALQEKQTDLSAVRFGAIGIGSREYDTFCGAIDKLEAALKACGAKQIGETLKINVLEHEIPEDPAEIWLGSWKNLL

SEQ ID NO: 14041 - protein, 80 aa, Klebsiella pneumoniae
TGTRPNSQGGAGGKFFKGANPMKLFPCGKKASGFKAIPAGGRGGGKTPPWDAPNKIRGFMPHARVSGGEAIYIFGVKPSR

SEQ ID NO: 14042 - protein, 145 aa, Klebsiella pneumoniae
WSKREKMKKGTVLNADISAVISRLGHTDTLVVCDAGLPVPRSSTRIDMALTQGVPSFMQVLEVVTTEMQVEAAVIAEEIKTHNPQLHATLLTHLEQLQQHQGNTIEIRYTSHEQFKKQTADSQAVIRSGECSPFANIILCAGVTF

SEQ ID NO: 14043 - protein, 330 aa, Klebsiella pneumoniae
KKKSRAGATGSRWRAFPGTEMMKTAGKLVVLGSINADHILNLDAFPTPGETVTGHHYQVAFGGKGANQAVAAGRSGADIAFIACTGDDDIGERIRRQLASDKIDVAPVRAVAGEATGVALIFVNAEGENVIGIHAGANAALSVSQVEAEKERIASAQALLMQLESPLESVIAAAKIAHHHHTTVVLNPAPARELPDELLALVDIITPNETEAEKLTGIRVESDEDAAKAADVLHAKGIGTVMITLGSRGVWLSAEGESRRIPGFRVQAIDTIAAGDTFNGALVTALLEGTALPEAIRFAHAAAAIAVTRKGAQPSVPWRTEIDEFLAQQG

SEQ ID NO: 14044 - protein, 469 aa, Klebsiella pneumoniae
QGFGMSGKKGRSMAGLPWIAAMAFFMQALDATILNTALPAIAHSLNRSPLAMQSAIISYTLTVAMLIPVSGWLADRFGTRRVFIIAVSLFTLGSLACALSSSLTELVIFRVIQGIGGAMMMPVARLALLRAYPRSELLPVLNFVTMPGLVGPILGPVLGGVFVTWASWHWIFLINIPIGVIGILYARKYMPNFTTPRRRFDIGGFLLFGLSLVLFSSGIELFGEKIVATWQALAVIAVSLLLLVAYVRHARRHPTPLISLSLFKTHTFSVGIAGNLATRLGTGCVPFLMPLMLQVGFGYPAIIAGCMIAPTAIGSIIAKSTVTQVLRWFGYRKTLVGITVFIGLMIAQFSLQSPEMPLWMLLLPLFVLGMAMSTQFTAMNTITLADLTDDNASSGNSLLAVTQQLSISLGVAISAAVLRFYEGFDNASTVQQFHYTFITMGVITIISALMFMLLRAKDGRNLISERHKR

SEQ ID NO: 14045 - protein, 525 aa, Klebsiella pneumoniae
FAAGSVPRLRISFSVPASRSEVAVMEALLQLKGIDKAFPGVKALSGAALNVYAGRVMALVGENGAGKSTMMKVLTGIYTRDAGSLLWLGKETTFNGPKSSQEAGIGIIHQELNLIPQLTIAENIFLGREFVNRFGKIDWKQMYAEADKLLAKLNLRFTSQKLVGDLSIGDQQMVEIAKVLSFESKVIIMDEPTDALTDTETESLFRVIRELKSQGRGIVYISHRMKEIFEICDDVTVFRDGQFIAEREVSSLDEDRLIEMMVGRKLEDQYPHLDKAPGAVRLKVDNLCGPGVNNVTFTLRQGEILGVAGLMGAGRTELMKVLYGALPRSSGSVTLDGREVVTRSPQDGLANGIVYISEDRKRDGLVLGMSVKENMSLTALRYFSRAGGSLKHKDEQQAVSDFIRLFNVKTPSMEQAIGLLSGGNQQKVAIARGLMTRPKVLILDEPTRGVDVGAKKEIYQLINQFKADGLSIILVSSEMPEVLGMSDRIIVMHEGHLGGEFTREQATQEVLMAAAVGKLNRVNQE

SEQ ID NO: 14046 - protein, 155 aa, Klebsiella pneumoniae
EKDMENYQIDNLDRGILDALMANARTAYAELAKQFSVSPGTIHVRVEKMKQAGIITGARIDVSPKQLGYDVGCFIGIILKSAKDYPSALARLESLEEVTEAYYTTGHYSIFIKVMCKSIDALQQVLINKIQTIDEIQSTETLIVLQNPIMRTIKP

SEQ ID NO: 14047 - protein, 564 aa, Klebsiella pneumoniae
NKCVPSPLAHKKRTVCTIICEIVPLTDTILTWLKKNKSILQAITAPALTSILVPITIHDKARNSIMAQTHLLAERISRLSAALEKGLFERSHAIRLCLLAALSGESVFLLGPPGIAKSLIARRLKFAFQQARAFEYLMTRFSTPEEVFGPLSIQALKDEGRYERLTAGYLPEAEIVFLDEIWKAGPAILNTLLTAINERHFRNGAHEEKIPMRLLVAASNELPEADSSLEALYDRMLIRLWLDKVQDKGNFRSMLVSQQDENSNPVPSALQVSDEEFTQWQQQIGNIKLPDAVFELIFQLRQQLDALPNAPYVSDRRWKKAIRLLQASAFFSGRDSIAPIDLILLKDCLWHNVESMNLMSQQLETLMTCHAWQQQAMLTRLGAIVQRRIQIQQQQSDKTALKVTRLGGMFSRKPHYELPAEIQGTTLTLLLQQPLKLHDMEVIHITFEREALANWLEKGGEIRGKLNGIGFAQLLNMDVDTSQHLVVRDVSLQGSRLALPGSAAQENMPAEIRQQLEALDDEWHQQHNRFSEQQKCLFIPVEWLGRIEASLQDVGAQIKQAKQP

SEQ ID NO: 14048 - protein, 170 aa, Klebsiella pneumoniae
ISSSNASASSRQVCDPRPSMLARCGSSSVRWTSLSLISLIAASRASTLTSRSSPVWPVNWCFIITPSLSVAQASLSIVGLKKRQSRAATLRVAWFCSTLAENIEEMIMQVNDRVTVKTDGGPRRSGVVLAIESFSEGTMYLVSLEDYPLGIWFFNEIGHPDGIFVEKEVS

SEQ ID NO: 14049 - protein, 212 aa, Klebsiella pneumoniae
SICSKTATTCRKCTITARSPTRSQPPCDAAASTVNRRRVMAIILGIDPGSRVTGYGVIRQVGRQLSYLGSGCIRTKVDDLPSRLKLIYAGVTEIITQFQPDYFAIEQVFMAKNADSALKLGQARGVAIVAATNQALPVFEYAARQVKQTVVGIGSAEKSQVQHMVRTLLKLPANPQADAADALAIAITHCHVSQNAAQISETRLNLARGRLR

SEQ ID NO: 14050 - protein, 505 aa, Klebsiella pneumoniae
AISSWIRSTAFCCCSWLSEGKPANIFYSCYIVGRNYFTPSPTTPEGRQRSGSRKMLSPAIITLPWRPDAAEHYFAPLSALPWAMLLHSGFADHPHNRFDILVAAPRATLLTRGEQTWVDDGETVVVSAEDPLQLLQQQLDRQPFTPQPHDDLPFLGGALGLFGYDLGRRFERLPSHAQADIALADMAVGIYDWALIVDHQRQQISLLSYDDPQQRLQWLEAQTPTPGETFALTSAWQSNMSRQQYGEKFRQVQAYLHSGDCYQVNLAQRFQASYVGDEWQAFRQLNAVNRAPFSAFIRLDEGAILSLSPERFIQLRQGEIQTRPIKGTLPRLDSPLADAQQAEKLANSPKDRAENLMIVDLMRNDIGRVAVPGSVRVPELFVVEPFPAVHHLVSTITARLPMTLHASDLLRAAFPGGSITGAPKVRAMEIIDELEPQRRNAWCGSIGYLSYCGNMDTSITIRTLTAWQGQLYCSAGGGIVADSEEAAEYQETFDKVNRILQQLEN

SEQ ID NO: 14051 - protein, 78 aa, Klebsiella pneumoniae
TRISMSTPDFSTAENKQELAQEVSCLKAMITLMLQAMGQADAGRVIIKMEKQIAQMEDEAQAAVFSSTVKQIKQAYRQ

SEQ ID NO: 14052 - protein, 327 aa, Klebsiella pneumoniae
MMSSVTTSGATRSTFSFARIWDQFGMLVVFAVLFIGCVIFVPNFASFVNMKGLGLAISMSGMVACGMLFCLASGDFDLSVASVIACAGVTTAVVINLSESLWLGIAAGLLLGALSGLVNGFVIARLKINALITTLATMQIVRGLAYIISDGKAVGIEDERFFTLGYANWFGLPAPIWLTVACLVVFGLLLNKTTFGRNTLAIGGNEEAARLAGVPVVRTKIIIFVLSGLVSAAAGIILASRMTSGQPMTSIGYELIVISACVLGGVSLKGGIGKISYVVAGILILGTVENAMNLLNISPFSQYVVRGVILLAAVIFDRYKQKAKRAA

SEQ ID NO: 14053 - protein, 2042 aa, Klebsiella pneumoniae
DVPSGGRMISGAPSQDSLLPDNRHAADYQQLRERLIQELNLTPQQLHEESNLIQAGLDSIRLMRWLHWFRKNGYRLTLRELYAAPTLAAWNQLMLSRSPENAEEETPPDESSWPNMTESTPFPLTPVQHAYLTGRMPGQTLGGVGCHLYQEFEGHCLTASQLEQAITTLLQRHPMLHIAFRPDGQQVWLPQPYWNGVTVHDLRHNDAESRQAYLDALRQRLSHRLLRVEIGETFDFQLTLLPDNRHRLHVNIDLLIMDASSFTLFFDELNALLAGESLPAIDTRYDFRSYLLHQQKINQPLRDDARAYWLAKASTLPPAPVLPLACEPATLREVRNTRRRMIVPATRWHAFSNRAGEYGVTPTMALATCFSAVLARWGGLTRLLLNITLFDRQPLHPAVGAMLADFTNILLLDTACDGDTVSNLARKNQLTFTEDWEHRHWSGVELLRELKRQQRYPHGAPVVFTSNLGRSLYSSRAESPLGEPEWGISQTPQVWIDHLAFEHHGEVWLQWDSNDALFPPALVETLFDAYCQLINQLCDDESAWQKPFADMMPASQRAIRERVNATGAPIPEGLLHEGIFRIALQQPQALAVTDMRYQWNYHELTDYARRCAGRLIECGVQPGDNVAITMSKGAGQLVAVLAVLLAGAVYVPVSLDQPAARREKIYADASVRLVLICQHDASAGSDDIPVLAWQQAIEAEPIANPVVRAPTQPAYIIYTSGSTGTPKGVVISHRGALNTCCDINTRYQVGPHDRVLALSALHFDLSVYDIFGVLRAGGALVMVMENQRRDPHAWCELIQRHQVTLWNSVPALFDMLLTWCEGFADATPENLRAVMLSGDWIGLDLPARYRAFRPQGQFIAMGGATEASIWSNACEIHDVPAHWRSIPYGFPLTNQRYRVVDEQGRDCPDWVPGELWIGGIGVAEGYFNDPLRSEQQFLTLPDERWYRTGDLGCYWPDGTIEFLGRRDKQVKVGGYRIELGEIESALSQLAGVKQATVLAIGEKEKTLAAYVVPQGEAFCITDHRNPALPQAWHTLAGTLPCCAISPEISAEQVADFLQHRLLKLKPGHTAGADPLPLMNSLAIQPRWQAVVERWLAFLVTQRRLKPAAEGYQVCAGEEREDEHPHFSGHDLTLSQILRGARNELSLLNDAQWSPESLAFNHPASAPYIQELATICQQLAQRLQRPIRLLEVGTRTGRAAESLLAQLNAGQIEYVGLEQSQEMLLSARQRLAPWPGARLSLWNADTLATHAHSADIIWLNNALHRLLPEDPGLLATLQQLAVPGALLYVMEFRQLTPSALLSTLLLTNGQPEALLHNSADWAALFSAAAFNCQHGDEVAGLQRFLVQCPDRQVRRDPRQLQAALAGRLPGWMVPQRIVFLDALPLTANGKIDYQALKRRHTPEAENPAEADLPQGDIEKQVAALWQQLLSTGNVTRETDFFQQGGDSLLATRLTGQLHQAGYEAQLSDLFNHPRLADFAATLRKTDVPVEQPFVHSPEDRYQPFALTDVQQAYLVGRQPGFALGGVGSHFFVEFEIADLDLTRLETVWNRLIARHDMLRAIVRDGQQQVLEQTPPWVIPAHTLHTPEEALRVREKLAHQVLNPEVWPVFDLQVGYVDGMPARLWLCLDNLLLDGLSMQILLAELEHGYRYPQQLLPPLPVTFRDYLQQPSLQSPNPDSLAWWQAQLDDIPPAPALPLRCLPQEVETPRFARLNGALDSTRWHRLKKRAADAHLTPSAVLLSVWSTVLSAWSAQPEFTLNLTLFDRRPLHPQINQILGDFTSLMLLSWHPGESWLHSAQSLQQRLSQNLNHRDVSAIRVMRQLAQQQNVPAVPMPVVFTSALGFEQDNFLARRNLLKPVWGISQTPQVWFDHQIYESEGELRFNWDFVAALFPAGQVERQFEQYCALLNRMAEDESGWQLPLAALVPPVKHAGQCAERSPRVCPEQSQPHIAADESTVSLICDAFREVVGESVTPAENFFEAGATSLNLVQLHVLLQRHEFSTLTLLDLFTHPSPAALADYLAGVTTVEKTKRPRPVRRRQRRI

SEQ ID NO: 14054 - protein, 513 aa, Klebsiella pneumoniae
YRKSLTIIKPAVAGFFIYPTGWRVVSCRFAQDHTLDGSDNMNTAISSRDERAFSAPALLVAGAFFMEFLDGTVIATALPDMARDFGVTAVELNIGISAYLITLAVLIPASGWIADRFGARAIFTLALAIFTLASVFCGLSTEVHIFVAMRILQGVGGALMVPVGRLAVLRTTPKHQLIKAIATLTWPALVAPIIGPPLGGFITRYASWHWIFFINVPLGLAAIILSLRIIPDIRETERRSFDLTGFITTSVAMVSLVTAMERLGDRQPQIWPTLALAALGFGCLLYSIRHFRRAAAPMVRLDALQVPTFRVTMYGGSLFRASISAVPFLLPLLFQVGFGMDPFHSGLLVLAVFVGNLTIKPATTPLIRWLGFRRLLLINGALNVCSLLACALLTPQTPVWAIMLILYLGGVFRSIQFTGVSTLAFADVPAAQMSDANTLFSTASQLAVGLGITLGAIGIRLGEQVGDWLHLTELPGISFRLSFVFIALICLVGMIDSLHLAKTAGSSVSEKKK

SEQ ID NO: 14055 - protein, 228 aa, Klebsiella pneumoniae
QCLSPERKTMANWLHQLQSLLGQQGASPSGESSKGSGLLPGAIGGLAGLLVASKSSRKLLAKYGTSALLAGGGAVAGTVLWNKYQQKMRAQNTSAQAPETAAAPAEVDPRSVRLITALVFAAKSDGHIDDHERANIETQLRAANIDVQARVLIDQALAQPLDPQRLAEGIIDPQEALEIYYVSCAVIDIDHFMERSYLNALGDALALPKDVRADIEQDIQSQKQALSV

SEQ ID NO: 14056 - protein, 305 aa, Klebsiella pneumoniae
GSMSTRQLLPLIGALFALYIIWGSTYFAIAVGVASWPPLMMAGIRFLAAGVLLLGWLLATGHKLPARRPLLNAALIGVLLLAVGNGFVTLAEHQHVPSGIAAVMVATVPLFTLCFSRFFGIATRKLEWLGIAIGLAGIVMLNSGGNLNGNPWGALLILIGSLSWAFGSVYGSRIVLPTGMMAGAIEMLAAGIVLLAASWLSGETLTRVPSWSGIAALAYLAIFGSLIAINAYMFLIRNVTPAVATSYAYVNPVVAVLLGTGFGGESLSLIEWLALAVIIFAVVLVTLGKYLFPVRSEATPCKASK

SEQ ID NO: 14057 - protein, 263 aa, Klebsiella pneumoniae
RSSSAYDTDRHPGPVAGAGLLAAVHRQPGDLQSVHPAGGRRGALASASPGSQPSAIGNRPAARGFSGGSGSGLRGYRRSVSRAFGARRNPSRLVSTGRQRGAVAAAGAVPGGGASGTGIAGFRAAGGGTGAPPLRGASGAVAARLAAEYRSVPNLAKRSAAGVERVLGDAARRPGRGKPLVYRHAGEAWSPGAAEGTSAPGGCRVAAGGQPCLTPASDAVAGEHSDLGRKRSFPAIPRPAGRTSSAEPVCRGHLPYAGGGGGE

SEQ ID NO: 14058 - protein, 235 aa, Klebsiella pneumoniae
IMNPDTSAVLKPRRGRPPKVDRQFDDTRQALIRSGLEVLTETGYLAAGIDAVIKNIAVPKGSFYHCFKSKEAFGLAVLAAYGDFFAHKLDKFLLDDAVPPLERMAAFVRHAGQGMEKFQFRRGCLVGNLLQEAPLLPETFPQRLMAILAAWESRVARCLREAQAAEAIASDASPQALAQVFWIGWEGAVMRARLVQSAAPLNQYWDFFAHSMTTKTPAQDGASADNPLPTRNTLS

SEQ ID NO: 14059 - protein, 272 aa, Klebsiella pneumoniae
NGDPFLIHLPCYLRYSGSGMMSAIVTLCNGNLTMVIKAQSPAGFAEEYIIESIWNNRFPPGSILPAERELSELIGVTRTTLREVLQRLARDGWLTIQHGKPTKVNNFWETSGLNILETLARLDHDSVPQLIDNLLSVRTNISTIFIRTAFRQHPDKALAVLDSAREVEDHADAFAELDYNIFRGLAFASGNPIYGLILNGMKGLYTRIGRHYFSSPEARSLALGFYHQLAKVCEAGLHDQVYELVRRYGHDSGEIWHRMQKSLPGDLAMNMR

SEQ ID NO: 14060 - protein, 585 aa, Klebsiella pneumoniae
GELPMTSTDARRPAVLPCSLRLAIGGALIALMSLNAQAEDGKTAPPPSPDILLGPLFNDVQSAKLFADQKTFADAIPNSDPLMILADYRMQKNQASFDLRHFVELNFTLPKENDTYVPPKGQTLRQHIDGLWPVLTRSTVEVEKWDSLLPLPKPYVVPGGRFREVYYWDSYFTMLGLAESGHWDKVEDMVANFAAEIDAWGHIPNGNRTYYLSRSQPPFFSFMVSLLATHDGDQVLKTYQPQLEKEYRYWMAGADALAPGSADKRAVRMADGALLNRYWDDNDTPRPESWLDDVKTAKSNPNRPATEIYRDLRSAAASGWDFSSRWMDNPQQLATIRTTSIVPVDLNALMFHLEKTLARASKASGDSAGATQYDALANARQQAIEKYLWNDKEGWYADYDLKSHKVRNQLTAAALFPLYVNAASRERATKVAAAAESRLLKPGGLTTTTVNSGQQWDAPNGWAPLQWVAVEGLQNYGQQKIAMEVTWRFLTNVQHTYDSKQKLVEKYDVSSTGTGGGGGEYPLQDGFGWTNGVTLKMLDLICPQEKPCDALPATRPATTPSPQDKPVAAPAANDPAPAEPQKTGS

SEQ ID NO: 14061 - protein, 341 aa, Klebsiella pneumoniae
LIYPIRFYLYPHWSKPQGDNQVMTESPQTQSEISIHQLVVGKPANDGNIPAQCELLRCSLQEGMDILLWRGHFARPETLQLHDDLGRINFSCILEGTSRFAIQGLRRHTDWELARNRHYITHTPDCRGSASYCGRFESITLSFSPATLALWVPDISADIKNKIDSHCCCQQQRCNAETHLTAQALRHALMRMHGGFSHEQKPSTLWLQGQSLVMLSLVLDEHREDASCLSCHFNPMERQKLLRAKDLLLADLTQAPGVAELARESGLSVLKIKRGFRVLFNNSVYGLFQAERMQEARRRLANGNTSVMTVAADLGYANASHFSAAFQKQFGVTPSTFKRVM

SEQ ID NO: 14062 - protein, 425 aa, Klebsiella pneumoniae
WSDPHMSLTDAKIRTLKPSDKPFKVSDSHGLYLLVKPGGSRHWYLKYRINGKESRIALGAYPAVSLSDARQQREGVRKMLALNINPVQQRAAERGSRTPDKVFKNVALAWHKSNRKWSQNTADRLLASLNNHIFPVIGNLPVSELKPRHFIDLLKRIEEKGLLEVASRTRQHLSNIMRHAVHQGLIDTNPAANLGGVTTPPVRRHYPALPLERLPELLERIGAYHQGRELTRLGVLLMLHVFIRSSELRFARWSEIDFTNRVWTIPATREPIIGVRYSGRGAKMRMSHIVPLSEQSIAILKQIKDITGNNELIFPGDHNPYKPMCENTVNKALRVMGYDTKKDICGHGFRAMACSALMESGLWAKDAVKRQMSHQERNTVRMAYIHKAEHLEARKAMMQWWSDYLEACRESYAPPYTIGKNKFIP

SEQ ID NO: 14063 - protein, 502 aa, Klebsiella pneumoniae
TARPGVTRRGVCAKLRTLFFCGALPVAENTVYFPEAFLAQMRAAMPAHLSFDDFIAACQRPLRRSIRVNTLKISVDDFLSLVAPYGWQLAPVPWCAEGFWIEREDDDALPLGSTAEHLSGLFYIQEASSMLPVAALFADNRQPERVMDVAAAPGSKTTQIAARMGNAGGILANEFSASRVKVLHANISRCGISNVALTHFDGRVFGAALPETFDAILLDAPCSGEGVVRKDADALKNWSPDSNLDIAATQRELIDSAFHALRPGGTLVYSTCTLNREENQSVIEWLLSRYPQAVEILPLGELFPGAADALTAEGFLHVFPQIYDCEGFFVARLRKTAAIDPLPAPGYKVGKFPFTPLKDREAAAVTAAARAVGLEWDAGHTLWQRDKELWLFPLALEPLFGKVRFSRIGVRLAELHNKGYRWQHEAVIAFAAPQRAFELSQEEAEEWYRGRDVYPQTAPGQDETIVTFQGVPLGLAKRVGSRLKNSYPRELVRDGKLFAGKV

SEQ ID NO: 14064 - protein, 193 aa, Klebsiella pneumoniae
YSSFADFIALNSFHNTAYPQGQQFCSLLTMDTGHPMSITIRQATPDDATAIYDMIYELAVYEKAPEEVVTTPEEIRETLFASGSKTEALICEVAGKAVGYAVFFTSYSTWLGRNGIYMEDLYVTPDYRGIGAGKALLKTIAQYAVQRQCGRLEWSVLDWNQPAIDFYLSIGAQPQDEWVRYRLTGDALRAFAE

SEQ ID NO: 14065 - protein, 194 aa, Klebsiella pneumoniae
KNPPVDILAKRHPSLLKGDYPAGVIWQQAKDYCQWLGIKSGKKIDLPTEAQWEFAARSRGQYLPFATNNGEFSPGKNVPSQDELNKYTDGMGLPIYPVGKYPSNPLGLYDMGLSGSEWTNDWYAADYYSNSPVKNPQGPEQGTEKVLRGNVGGDRQYALTMFRQSASPLPEEVDGDYEKYGVGPQYVFRCVINK

SEQ ID NO: 14066 - protein, 110 aa, Klebsiella pneumoniae
SSRPDAAARPPRQGGSLRVPPDASPPARSPSQPPLTPPARCHVPANAAPPPHNPAAARVAPDSARCRANRSGHGGAPRCRAACPAASTQKNGSSPAETAPARPGCDDKSG

SEQ ID NO: 14067 - protein, 3168 aa, Klebsiella pneumoniae
ETGPIMDNLRFSSAPTADSIDASIAQHYPDCEPVAVIGYACHFPESPDGETFWQNLLEGRECSRRFTREELLAVGLDAAIIDDPHYVNIGTVLDNADCFDATLFGYSRQEAESMDPQQRLFLQAVWHALEHAGYAPGAVPHKTGVFASSRMSTYPGREALNVTEVAQVKGLQSLMGNDKDYIATRAAYKLNLHGPALSVQTACSSSLVAVHLACESLRAGESDMAVAGGVALSFPQQAGYRYQPGMIFSPDGHCRPFDASAEGTWAGNGLGCVVLRRLRDALLSGDPIISVILSSAVNNDGNRKVGYTAPSVAGQQAVIEEALMLAAIDDRQVGYIETHGTGTPLGDAIEIEALRNVYAPRPQDQRCALGSVKSNMGHLDTAAGIAGLLKTVLAVSRGQIPPFLNFHTPNPALKLEESPFTIPVSAQAWQDEMRYAGVSSFGIGGTNCHMIVASLPDALNARLPNTDSGRKSTALLLSAASDSALRRLATDYAGALRENADASSLAFTALHARRLDLPFRLAAPLNRETAEALSAWAGEKSGALVYSGHGASGKQVWLFTGQGSHWRTMGQTMYQHSTAFADTLDRCFSACSEMLTPSLREAMFNPDSAQLDNMAWAQPAIVAFEIAMAAHWRAEGLKPDFAIGHSVGEFAAAVVCGHYTIEQVMPLVCRRGALMQQCASGAMVAVFADEDTLMPLARQFELDLAANNGTQHTVFSGPEARLAVFCATLSQHDINYRRLSVTGAAHSALLEPILDRFQDACAGLHAEPGQIPIISTLTADVIDESTLNQADYWRRHMRQPVRFIQSIQVAHQLGARVFLEMGPDAQLVACGQREYRDNAYWIASARRNKEASDVLNQALLQLYAAGVALPWADLLAGDGQRIAAPCYPFDTERYWKERVSPACEPADAALSAGLEVASRAATALDLPRLEALKQCATRLHAIYVDQLVQRCTGDAIENGVDAMTIMRRGRLLPRYQQLLQRLLNNCVVDGDYRCTDGRYVRARPIEHQQRESLLTELAGYCEGFQAIPDTIARAGDRLYEMMSGAEEPVAIIFPQSASDGVEVLYQEFSFGRYFNQIAAGVLRGIVQTRQPRQPLRILEVGGGTGGTTAWLLPELNGVPALEYHFTDISALFTRRAQQKFADYDFVKYSELDLEKEAQSQGFQAQSYDLIVAANVIHATRHIGRTLDNLRPLLKPGGRLLMREITQPMRLFDFVFGPLVLPLQDLDAREGELFLTTAQWQQQCRHAGFSKVAWLPQDGSPTAGMSEHIILATLPGQAVSAVTFTAPSEPVLGQALTDNGDYLADWSDCAGQPERFNARWQEAWRLLSQRHGDALPVEPPPVAAPEWLGKVRLSWQNEAFSRGQMRVEARHPAGEWLPLSPAAPLPAPQTHYQWRWTPLNVASIDQPLTFSFSAGTLARSDELAQYGIIHDPHASSRLMIVEESEDTLALAEKVIAALTASAAGLIVVTRRAWRVEENEALSASHHALWALLRVAANEQPERLLAAIDLAENTPWETLHQGLSAVSLSQRWLAARGDTLWLPSLAPNTGCAAELPANVFTGDSRWHLVTGAFGGLGRLAVNWLREKGARRIALLAPRVDESWLRDVEGGQTRVCRCDVGDAGQLATVLDDLAANGGIAGAIHAAGVLADAPLQELDDHQLAAVFAVKAQAASQLLQTLRNHDGRYLILYSSAAATLGAPGQSAHALACGYLDGLAQQFSTLDAPKTLSVAWGAWGESGRAATPEMLATLASRGMGALSDAEGCWHLEQAVMRGAPWRLAMRVFTDKMPPLQQALFNISATEKAATPVIPPADDNAFNGSLSDETAVMAWLKKRIAVQLRLSDPASLHPNQDLLQLGMDSLLFLELSSDIQHYLGVRINAERAWQDLSPHGLTQLICSKPEATPAASQPEVLRHDADERYAPFPLTPIQHAYWLGRTHLIGYGGVACHVLFEWDKRHDEFNLAILEKAWNQLIARHDMLRMVVDADGQQRILATTPEYHIPRDDLRALSPEEQRIALEKRRHELSYRVLPADQWPLFELVVSEIDDCHYRLHMNLDLLQFDVQSFKVMMDDLAQVWRGETLAPLAITFRDYVMAEQARRQTSAWHDAWDYWQEKLPQLPLAPELPVVETPPETPHFTTFKSTIGKTEWQAVKQRWQQQGVTPSAALLTLFAATLERWSRTTTFTLNLTFFNRQPIHPQINQLIGDFTSVTLVDFNFSAPVTLQEQMQQTQQRLWQNMAHSEMNGVEVIRELGRLRGSQRQPLMPVVFTSMLGMTLEGMTIDQAMSHLFGEPCYVFTQTPQVWLDHQVMESDGELMFSWYCMDNVLEPGAAEAMFNDYCAILQAVIAAPESLKTLASGIAGHIPRRRWPLNAQADYDLRDIEQATLEYPGIRQARAEITEQGALTLDIVMADDPSPSAAMPDEHELTQLALPLPEQAQLDELEATWRWLEARALQGIAATLNRHGLFTTPEIAHRFSAIVQALSAQASHQRLLRQWLQCLTEREWLIREGESWRCRIPLSEIPEPQEACPQSQWSQALAQYLETCIARHDALFSGRCSPLELLFNEQHRVTDALYRDNPASACLNRYTAQIAALCSAERILEIGAGTAATTAPVLKATRNTRQSYHFTDVSAQFLNDARARFHDESQVSYALFDINQPLDFTAHPEAGYDLIVAVNVLHDASHVVQTLRRLKLLLKAGGRLLIVEATERNSVFQLASVGFIEGLSGYRDFRRRDEKPMLTRSAWQEVLVQAGFANELAWPAQESSPLRQHLLVARSPGVNRPDKKAVSRYLQQRFGTGLPILQIRQREALFTPLHAPSDTPTEPAKPTPVAGGNPALERQVAELWQSLLSRPVARHHDFFELGGDSLMATRMVAQLNRRGIARANLQDLFSHSTLSDFCAHLQAATSGEDNPIPLCQGDGEETLFVFHASDGDISAWLPLASALNRRVFGLKAKSPQRFATLDQMIDEYVGCIRRQQPHGPYVLAGWSYGAFLAAGAAQRLYAKGEQVRMVLIDPVCRQDFCCENRAALLRLLAEGQTPLALPEHFDQQTPDSQLADFISLAKTAGMVSQNLTLQAAETWLDNIAHLLRLLTEHTPGESVPVPCLMVYAAGRPARWTPAETEWQGWINNADDAVIEASHWQIMMEAPHVQACAQHITRWLCATSTQPENTL

SEQ ID NO: 14068 - protein, 202 aa, Klebsiella pneumoniae
YFLPGRWRRFGFRLHCHDLASSREMIMLQYLNQCSRGRGAWLLMALTAFILELVALWFQHVMLLQPCVMCIYERCALFGIMGAGLVGAIAPKTPLRYVAMVIWLYSAIRGLQLAWEHTMIQLHPSPFQTCDFAARFPTWLPLDKWLPQVFVASGDCSVRQWQFLSLEMPQWLVGIFAAYLLVAILVIIAQPFKAKKRDLFGR

SEQ ID NO: 14069 - protein, 263 aa, Klebsiella pneumoniae
MTPPRGRIVRQHRAGGQNEVLSPATPSSGRLMSTIIDTFVAPPCREQITLLYQDEHLLLINKPAGLLSLSGKDPRNLDSVHHRLVQRFPGCTLVHRLDFGTSGLMVIARNKGINALLCQQFSQRTVDKVYTALLCGHLAEDEGIVEAAIAKDPARFPRMALCARHGKPARSRYRVINRLYQAREGERALALTRVTLTPETGRTHQLRIHCQLLGYPILGCDLYGGRELPGTEQAPRLMLHASELRFVHPVSHEPMHIQQASPF

SEQ ID NO: 14070 - protein, 97 aa, Klebsiella pneumoniae
PRWPLTVLTRYWTSRWRIPVSRPCGPMPAICCSRPISGGFTITTMTRGRMSGWSWLSAPGWRNICNERSLSPSVRSCSGCAAPITSAISLFMRCCGR

SEQ ID NO: 14071 - protein, 90 aa, Klebsiella pneumoniae
IMALLDFFLSRKKNTANIAKERLQIIVAERRRGDAEPHYLPQLRKDILEVICKYVQIDPEMVSVQLEQRDGDISILELNVTLPETEESKS

SEQ ID NO: 14072 - protein, 119 aa, Klebsiella pneumoniae
PSKFHTQGYHPIITTPQPVLLYCSNKHRIYALSHTHSKLVVIMVVLTGRATRFSLFISQLLAWAIPVRGAKFKKPAFEQAFCFSAPVLLPEGEWPPSGDCGFSVNSLPSDLSPAAPHKK

SEQ ID NO: 14073 - protein, 592 aa, Klebsiella pneumoniae
ISWLQNNAGAMVLKKKTKSAASFTPIRFGLLCVAILGCLGLLLVRVGWLQIISPDNLVKQEDMRSLREEPVAVERGMISDREGRPLAVSVPVSAIWIDPQTTMEKGGVGYGPRWQAMAEALHLNLGELAQRVQSHPHARFLYLARQINPEQAEWIDKLHLPGVYLRDESRRFYPAGHVAANLLGFTNVDNQGIEGVEKSFNAQLTGKPGRRLVRKDKHGNVIENITEVPPVPAHNLQLSIDERLQTVTEDALDNAVRWNKAESGAAVLIKIDTGEILAMASYPDFNPNNRDSATLDDFRNRAISDTFEPGSTVKPLVIMTALQQGIVQPDSVVDTHPFVLDGHRIRDVGYYPELSLTGILQKSSDTGVSHLSLAMPVQHLIDTYKAFGFGEPTGLGLTGESAGLMPHRRYWGQLDRATFAFGYGLMVTPLQLAHVYATIGGFGIARPLSITRIDPPVMGTRVMPESIVHSVEHMMESVALPGGGGTKAAVRDYRVAVKTGTAKKIGPDGKYIDKYVAYTAGVAPASRPQFALVVVMNDPSNGSYYGGAVSAPVFSQIMGDVLRLENVMPDGMPQGAENLIVMHDSHPQGPAL

SEQ ID NO: 14074 - protein, 186 aa, Klebsiella pneumoniae
LPVTMQFNIPTLLTLFRVILIPFFVLAFYLPFSWAPFACALIFFVAAVTDWFDGFLARRWNQSTRFGAFLDPVADKVMVAIAMVLVAEHYHTWWVTLPAATMIAREIIISALREWMAELGKRSSVAVSWIGKVKTTAQMTALVWMLWRPYPWVEWAGIALFLVAAVLTLWSMLQYLNAARGDLLDQ

SEQ ID NO: 14075 - protein, 784 aa, Klebsiella pneumoniae
AGSTPRRRWPDFLFCRETMFMKVDIDTQDVRYADAWLGFRGTAWQTQIDVRDFIQHNYTPYEGDESFLADATPATTALWEQVMAGIRVENATHAPVDFDTNVATSITAHAAGYINQPLEKIVGLQTDQPLKRALHPFGGIKMIKSAFEAYGREMDPDFEYQFTALRKTHNQGVFDVYSPDMLRCRKSGVLTGLPDGYGRGRIIGDYRRVALYGIRYLVRERELQFADLQPALERGEALEATLRLREELAEQRRALLQMQEMAARYGCDISHPARTAREAVQWLYFAYLAAVKSQNGGAMSLGRTATFLDIYIERDLRAGLLNEEQAQELIDHFIMKIRMVRFLRTPEFDSLFSGDPIWATEVLGGMGLDGRTLVSKTTFRYLHTLHTMGPAPEPNLTVLWSQALPAAFKKYAARVSIATSSLQYENDDLMRSDFHSDDYAIACCVSPMVIGKQMQFFGARANLAKTLLYAINGGVDEKLKIQVGPKTAPLRDEVLDYGTVMASLDHFMDWLAVQYISALNIIHCMHDKYSYEAALMALHDRDVYRTMACGIAGLSVAADSLSAIKYARVKPVRDHHGLAVDFVIEGDYPQYGNNDDRVDAIACDLVERFMRKIQALPTWRQAVPTQSILTITSNVVYGQKTGNTPDGRRAGTPFAPGANPMHGRDRKGAVASLTSVAKLPFTYAKDGISYTFSIVPAALGKAPSAQENNLVGLLDGYFHHEETVDGGQHLNVNVLNREKLLDAIEHPEQYPNLTIRVSGYAVRFNALTREQQQDVISRTFTSQL

SEQ ID NO: 14076 - protein, 106 aa, Klebsiella pneumoniae
YERFEMINEDLFIKNIHSKNQDRISVAMVYDTLSKEAHRGCGLYYEIYESCFIGLLRDHLSELNEADANRLRRYAESKGTKIDDASYSEALEAERECRAEIYREQM

SEQ ID NO: 14077 - protein, 61 aa, Klebsiella pneumoniae
SDTTQENAYHSPEAPFPGRTRTAASLLCRAAATPCPAYDPCGLSLIYLPLLLKFYRQVEDT

SEQ ID NO: 14078 - protein, 312 aa, Klebsiella pneumoniae
NQQTMNIMHPVLRRIDLNLLPVFDAVYRSRSVRLAAEELAMSTSALSHALSRLRSALNDPLFYREGHRMCPSVYASQLAPSIASALKFLNQELTPPAAFVPAASTDCMQIAITDFTAFCVFPTLMHHLQREAPGLRFELRYLPHSPALTELLAGEVDLALGFNTPDEPAHPDLEEINWLRDEYVVISQANRTALTLDAYLAARHLVVTPWNERQGVLDCELERQGYSRQVAMKTPSMLSAPFIIEQSDLLMALPRRAAETMARAARLTIFPLPFPVPPFDVKIYAHQRSGKREATRWLISLLQTLVGESTAS

SEQ ID NO: 14079 - protein, 244 aa, Klebsiella pneumoniae
SALTQRRYTMKTRFRTLILACVIASPLAHAGIPVAVDADPMRDVQWAQELKRWMETARHYQSQIQAYKDQLATATGVRDIADFVDQAKGLKAELEKLRKPGQALNDLLLSGGSSGQFDALYEKYKIFDTCNTAQSGSYANVCKQQVINKAIQLEQTDEVQNQVSQTLGEINSLSNRVALAKDSKESQDLANSIQLKSVMLNTLTTQWEMSVKAAEKRENALEAERVKQWNQQQLNAPTADLNNL

SEQ ID NO: 14080 - protein, 290 aa, Klebsiella pneumoniae
AMLTGLYITLRFGHFISLMLAFGCVLYGAWWAPVPLRRVLMLRFYPLLRPLLLIGAISTLALYLLQGGIMGEGWTDVWRPAVWLAVAGTRFGGVWIWQILLAWIALAVVWIRPRHGARQLVALLAAQLLLSAGVGHAAMHDGLTGVLQRTNHAVHLFCVASWFGGLLPFIYCLRLAQGRWRPAAVYTMARFSRYGHLAVAGTIASGALNALLIQGGLIGASPWGRMLLIKCALVAGMVVIALVNRYVLVPRMSASGSQAESLILRTTQAEIGLGALALLAVSLFATWEPY

SEQ ID NO: 14081 - protein, 252 aa, Klebsiella pneumoniae
ITMTNLVTLENVSVAFGQRRVLSDISLALTPGKILTLLGPNGAGKSTLVRVVLGLVAPTEGVIKRDARLRIGYVPQKLHLDATLPLTVSRFLRLRPGTRKDDILPALKRVQAGHLIDAPMQKLSGGETQRVLLARALLNRPQLLVLDEPTQGVDVNGQVALYDLINQLRHELDCAVLMVSHDLRLVMAKTDEVLCLNQHICCSGAPEVVSMHPEFISMFGPRGAEQLGIYRHHHNHRHDLQGRIVLRRGNSR

SEQ ID NO: 14082 - protein, 329 aa, Klebsiella pneumoniae
ILVTPIFFLNGTNCCVEGDNIMSKKYQPLLITHYMSTWVTITEAVEITTKAIKQKITPSDIYRHALSGNILLSVYFQSPVILKKIQTFNGKIKFRQFEGDLLDKLCMLDRDGFIYGQNLRLCTEARYVCPVQQIIDTPLIGYEYVLIQRILARELKFPSPIVGARKTNHGIIVRFSEELFQIFETMSWKERVEKQISRLPKNTALDVIKKLTEVTTIKYNHNGCFPLYTLPPDACFVIRHTEVERLINLYKKRESHPISPSRMTTPLSRLFWLACKHNDIISPLLNHPYKLLSIFEQWASGDGIGEKLDAETLKNALKRGSPSSTSLSG

SEQ ID NO: 14083 - protein, 103 aa, Klebsiella pneumoniae
ESSTCFKTCSCQNHARDHTNNEASMRLIIRTIILVAILWIGVLLSGYGVLFHSEENVGGLGLKCQYLTARGVSTALYVHSDSGVIGVSSCPLLRKSTTVVDNG

SEQ ID NO: 14084 - protein, 155 aa, Klebsiella pneumoniae
LATTDTPMSEQPFWQQKTLDDMSDAEWESLCDGCGQCCLHKLMDEDTDEIYFTNVACRQLNIKTCQCRNYARRFEYEPDCIKLTRENLPTFEWLPPTCAYRLLPEGKSLPAWHPLLTGSKAAMHGERISVRHIAVPESTVVDWQDHILNLPDRAR

SEQ ID NO: 14085 - protein, 191 aa, Klebsiella pneumoniae
EKTTWWQMIIDVEKLVKQLGKPYHEIYSHGLIPYKTKPYGPIDEDEDEDEDEDEDEDEDEDEAELDMKREGILLVFTNNSEKNLTEITLRLEDKGKTDWVFPNPMPFGMEPVMTQLWVRERFGLPMIYADVEIIMTIYMGVKEVYALPAPHQYIAAVFTYNKDLFVETVTFYPLERAKEIQAVLEKKRLES

SEQ ID NO: 14086 - protein, 70 aa, Klebsiella pneumoniae
EKKTWWQMNIDVETLVKQLGKPYQAIFEQGLIPYKTKPYDSVGDSTARLDMKREGIYLAFINDLEKNLKK

SEQ ID NO: 14087 - protein, 81 aa, Klebsiella pneumoniae
QGETCQPTGVTLRQTRCLTHDFHSFPLLVCRQNFRFRATCNASLSIMTSASNSLRWAFSSSNDLRRFTSGISMPSNFLRQV

SEQ ID NO: 14088 - protein, 62 aa, Klebsiella pneumoniae
KMFAGLPSLSHEQQQKAVERIHELMAQGISSGQAIALVAEELRATHTGEQIVARFEDEEEDE

SEQ ID NO: 14089 - protein, 63 aa, Klebsiella pneumoniae
EGRAILATLRTDAESGVKKLRWVLLIVIIAGCLLLWTQMLNVMCDQDVQFFSGICTINKFIPW

SEQ ID NO: 14090 - protein, 245 aa, Klebsiella pneumoniae
CALASSPSVGKPGQFHYAYCFALERAMLRVIDTETCGLQGGIVEIASVDIVDGQITNPMSHLVRPDRPISPQAMAIHRITEEMVADKPWIEEIIPHYHGSPWYVAHNASFDRRVLPEMHGEWICTMKLARRLWPGIKYSNMGLYKSRKLNVTTPPGLHHHRALYDCYITAALLLDIINVSGWTPDEMADITGRPALLTTFTFGKYRGKAVAEIAENDPGYLRWLFNNLDRMSPELRLTLRHYLGE

SEQ ID NO: 14091 - protein, 347 aa, Klebsiella pneumoniae
LWLAGGRESRGAGMIDFSNFYQLIAKSPLSHWLETLPAQVAAWQRDALHGKFREWERAVEFLPELTPWRLDLLHSVTAESETPLSEGHQRRIENLLKNLMPWRKGPYSLYGINIDTEWRSDWKWERVLPHLSDLTGRTILDVGCGSGYHMWRMIGAGAHLAVGIDPTQLFLCQFEAVRKLLGNDQRAHLLPLGIEQLPALEAFDTVFSMGVLYHRRSPLDHLWQLKDQLAPGGELVLETLVVEGDENTVLVPGDRYAQMRNVYFIPSAAALKMWLEKCGFIDVRIVDACVTSTEEQRRTEWMTTESLADFLDPQDQRKTVEGYPAPLRAVIIATKPETQQSLAKKAR

SEQ ID NO: 14092 - protein, 342 aa, Klebsiella pneumoniae
KMTAKNISLDRYKQRFFGDFLELPGLTEIAVNRPGELYTKINGVWEQHAVPLSYEDCYNFARCLAKHHGDNIEDIKPGLSATLESGERCQVIVPPACERDTVSITIRKPSKVQIPHQSYIDAGFYNRVTGEEKTETHDEELIALYNTKNIPLFMEKCVEYGKTLAVAGETSTGKTTYMKMLIGYIPVHLRISTIEDNPEITFFIHKNYVHLFYPSESSDEKGSIVTPASLLRWNYRMNPDRILLTEVRGAEAWDFLKITGSGHEGSMTSIHAGSAKEAIDGFITRCYENPQCAQLPYTFMLRKVLDSLDVIVSIDLDGNVRRMNDIYFRPIHRNQYFEEMKA

SEQ ID NO: 14093 - protein, 69 aa, Klebsiella pneumoniae
SSTATNKKPNVRPEFKPNFLVYRVIAASARFAGGNYQKWRGWSHCLYLHGSHIINNQLRLAMIRRKQGG

SEQ ID NO: 14094 - protein, 217 aa, Klebsiella pneumoniae
SPAALRGMVQQPSAIASLASFLPMQVYLPDVSSVSDTQMTKLTLQEQMLKAGLVSSKKMAKVQRTAKKSRVQAREAREAVEENKKAQLERDKQLSEQQKQAVLAKEYKAQVKQLIEMNRITVARGDIGFNFTDNNLIKKIMVDKPTQTQLINGRLAIARLAVDNKPEGEYAIIPAVVAEKIAQRDASSIVLHSALSQDEQDEDDPYADFKVPDDLMW

SEQ ID NO: 14095 - protein, 484 aa, Klebsiella pneumoniae
HPHANAPPVTCKGRAAFAIGFDNLFPVTEKIPPAFVAIVFAQRQRLFALIAIGHDHHAAWIVVSTATTKGDAVRMIEPKGLHAMGKTLTGVDQLVELFDNGHLNGIGLSVAAGILIGSAEEIGIKDRGHAILPQQDQRIGEGLEPGFNRRLEGLQRLRIMIGDQSDGMERVGFDQRPAENLAHVIIAALARRFMKFHLQWGIKQHRFALDQVDILLELLHFMGPVFRYNKQRLRGHLLNMLDPRFIKPGGDMLDRVKTKTVAAGLLHYPARPVFDLLGHCMIAEIDIGAHQIVKVAELIIDLFIPAFAGVIVDDFKHTVFRRVLDVVNAAKTFVVPDKLRILSGAHREGVARPCLALDDLLVNLRTILLIDALNAQSLFFISAHFMVDHHIQQHGDIVLLQGVDRRQQLRFVAIFGGDRPFLIKLAEVKEIVGIIADGVTARGAFVGGWQPDHIDADFIQAGRQRFDLRPQLAAGGVVPVKTLQ

SEQ ID NO: 14096 - protein, 108 aa, Klebsiella pneumoniae
GKNAKRPQHNAMRSWQIVECLSDSAGYLLHVFTSSLISFQAARILIRQLGEELRVTRFTQRNSCPQWIQGPHAHRRAPGNSFDNRWPELWLSKNASGFLLNQLCSDFV

SEQ ID NO: 14097 - protein, 578 aa, Klebsiella pneumoniae
TLDAAAVISLFILGSVLVTCSILLSSFSSRLGIPILVIFLAIGMLAGIDGIGGIPFDNYPFAYMVSNLALAVILLDGGMRTQASSFRVALWPALSLATVGVLITSALTGMMAAWLFKLDLIEGLLIGAIVGSTDAAAVFSLLGGKGLNERVGSTLEIESGSNDPMAVFLTITLIEMIQQHQTGLSWMFAVHIIQQFGLGIAIGLGGGYLLLQMINRIVLPAGLYPLLALSGGIMIFAVTTSLDGSGILAVYLCGFLLGNRPIRNRHGILQNFDGLAWLAQIAMFLVLGLLVTPSDLLPIAIPALLLSMWMIFIARPLSVFAGLLPFRGFNLRERVFISWVGLRGAVPIILAVFPMMAGLDNARLFFNVAFFVVLVSLLLQGTSLSWAAKKAKVVVPPISWPISRVGLDIHPENPWEQFVYQLGADKWCIGAALRDLHMPPETRIAALFRNNVLLHPTGSTRLREGDILCVIGREHDLPALGKMFSQSPPVALDQRFFGDFILDAEARFADVAQIYGLDGGEEFREHQQSLGEVVQQLLGAAPVVGDQVEFAGMVWTVAEKENDHVLKVGVRVAEDEAE

SEQ ID NO: 14098 - protein, 282 aa, Klebsiella pneumoniae
RRCATDGTLIREKMMRKTTGTLLATLLLAATGGSALSAEVTVMISGGFKAALEKLAPAWEKQTGNHLVVIPGPSMGKTPQAIPNRLARGEHADVVIMVGDALTSLEKAGRTQPDSRRELADSPIGVVVKAGAPLPAIHNADQLRATLLAAPSVAYSDSASGRYVSSTLFHTLGIDDAMQSKAQMVERIPVASEVAKGRYAIGFQQVSELLPVPGVTFVGELPDNLQYITRFAGAVTISADHPQEGKALLTYLASPAAQETIHATGMRSVAAAAPVSQKDTVQ

SEQ ID NO: 14099 - protein, 420 aa, Klebsiella pneumoniae
RNGATAIEVASGQQAADGGKAHPVAGRRFITGILNQRRGNHRREAAKHRGRQAVGQRETCHAHFGGHNFGQRRDHRPVVHAVDKRQPQQHAQHHQKARGVRQHGQRRPGGSQRQQGHGDQHRSAAKAVGQRPAHRQPEEVGNRHQQRDQQAVRGAEHQHLFTKGRGIDGDQVERGGGHRHHHHPGDNHLPVRQQGGEYLAHRQMMAAGSKLLGLLQLTAQDKNERNNQAAEKERNTPAPVADSARLQYRVEGKAHRGCHHDGNLLTARLPAGVKAFAARGGDLGQIDRHPAQLGAGGKALQQTADQHQQRRPQANGLIRGDQHDQEGAGGHDRQGDDQPLAPPHLVDIGAKYDSADGAHQKAGAKDREGHHQRGEFTARRKKGMGDVGGIKPEQEKVELFEKVTGRDAQNGADPVTGTHL

SEQ ID NO: 14100 - protein, 357 aa, Klebsiella pneumoniae
RGLALMLFSYTYVPHKMEKMQAFIDFIFYEVWCKARVRGPFCLKLFEANAELYEVMEDFSSSDTQGAVFFYNHVEKIYGLFSSLTEVQIDQFKQWYQGNNDLEKICANDPSIQVVRYSDIAIHHKDIAEQLAVFFKGLYSQSLLDLAVLRAKIGDIHDHYQSFAAVNKAGKCPFCGIGDIKGGNHSKREAYDHYLPKALYPFNSINFHNLAPACHECNSTYKLSKDPIQSGALRRKAFNPFASVDHVIQLQITLQHANIDALEPADIIIQFGPDTLEEELETWKDLYGIEERYKAKVCAENDGKYWLTQVLDEWKEEGVSPTEFMRTLARQAKKKPYAECNFLKEPFLKACHRIGVF

SEQ ID NO: 14101 - protein, 310 aa, Klebsiella pneumoniae
NCIAFIAFLRTGSVLANLEVKWLYDVIALEESRSFTLAAKARNISQSSFSRRIQSLEASLGFSIFDRSANPLQLTNRGKIFVGYARNMLDDMDFQISRIKGLNNTTQKIRIDAAPSLSVLLLPEIIAGYTDRKNKTFHVESINVNDAVFNLKEGKSDFILSFYNEELMNYPFINHKIFDSYLHLVSPCDEHGRPLFHLHRGVLPLMKYANDSYMGRQVNQVIDRTPEITFSLTFVSSMSELLKRMILNGDGVGWLPQYSIQRELDEGRLTILDESLSLPIGAWLYRSGSRLNQAAERFWQHIKTRNELRE

SEQ ID NO: 14102 - protein, 296 aa, Klebsiella pneumoniae
CTIATHRGRRCNSGLQGRIALHFRPFSNTGAVMSYSCPLCHAPLSRSDNHYSCPQRHQFDLAKEGYVNLLPVQFKRSRDPGDSAEMMQARRAFLDAGHYQPLRDAIAERLRHYAPTDLLDIGCGEGYYTHAFAAIASRSWGLDVSKPAIRAAAKRYPQVNFCVASSQRLPFSDASFDAVVRIYAPCNAEELARVVRPGGWVITATPGPRHLLELKGLIYDEVRLHELKTEAMPGFRLEAQQQLAYPMILTGSEAQALLQMTPFAWRAKAEVHAALRQQPTFGCQTDFMIHCWQREA

SEQ ID NO: 14103 - protein, 98 aa, Klebsiella pneumoniae
PASARCWRCPATARKATRHTARCLDEPSQNALPDARGSPPSWPASAGNPAPPPPVRYGASARQFPAGSPPPRSATSASSRRRCLSPAAAARRCGPAQA

SEQ ID NO: 14104 - protein, 185 aa, Klebsiella pneumoniae
CDLAGRSPTNEQARKSRDRPLRSRGNRSKEWKKGLFRVSQGGQMPYTHLLVAVAPTPESQVLIKKAVSIARPVNAKVSLITLATDPELYNQFAAPMMENLREVMQEETREFLNELARHADYPIERMTIACGELGHHIKDFCRSHRIDLVICGNHNHSLFSRATCSAKSIVGSCGVDVLLVSLEKG

SEQ ID NO: 14105 - protein, 157 aa, Klebsiella pneumoniae
KKMAAIINENVCVCLYARNARELSPRGKFAILYKNTVLRGCSMAVEIKYVVIREGEEKMSFASKKEADAYDKMLDLAEVLNDWLVASPLEMDDVQRDTMAMWLAERKEALQHILRVGRLPEQETPAQDASAPSATAETSPAGDDAVPAAKARKAKAA

SEQ ID NO: 14106 - protein, 146 aa, Klebsiella pneumoniae
KRAAKLAILRRTCGLSWRIWSAIATKSAGATANCSKMLPLRLRRPSFPIKEEGPAGIRRGLVLMRFFLWSKLQLNQRDRFLHRAKGHRIGRSRMAGEVDSFQLSGHFFTHFHRRNDVNDIEDLFDNQLAGNHIGNQLVVFGKMLRH

SEQ ID NO: 14107 - protein, 334 aa, Klebsiella pneumoniae
DTEAIMHITYDLPVSIDDILEAKQRLAGKIYKTGMPRSNYFSERCQGEIFLKFENMQRTGSFKIRGAFNKLCGLTAAEKRKGVVACSAGNHAQGVSLSCAMLGIDGKVVMPKGAPKSKVAATCDYSAEVVLHGDNFNDTLAKASDIVELEGRIFIPPYDDPQVIAGQGTIGLEILEDLYDVDNVIVPIGGGGLIAGIAIAIKSINPTIRIIGVQSENVHGMAASWYAGEITSHRHAGTLADGCDVARPGKLTYEIARQLVDDIVLVSEDDIRQSMVALIQRNKVITEGAGALACAALLSGKLDSYIQNRKTVSLISGGNIDLSRVSQITGFVDA

SEQ ID NO: 14108 - protein, 63 aa, Klebsiella pneumoniae
GTNLRFGREAVFNDNVFTQDFFTENATHKQNCTSFNPKRVITHYVNNGKPFLNVSRSFAQIIR

SEQ ID NO: 14109 - protein, 197 aa, Klebsiella pneumoniae
GVNFMLPSLNHIILTVALQALREGNIHHCETMGFTYDEMNLLGCLSINDLITLSQAPLPLVDITIRHDVLQKLLASSHEENRRQEQLNRAVRLGGSIALMNRYFGVGSRETCARRRLLGVSVPNGRTPIPDEETDAAIWHQWQKYRVENIDSPEALDAMMLVTENLSSCTAPSLTVVWNCITHCERKNTVRRIQRAR

SEQ ID NO: 14110 - protein, 83 aa, Klebsiella pneumoniae
PEFYLPPAKPLSPHAGDRRKSSSPAPDTGQRSPGRSLRPTSRCHSRYASDAGPGRAGTHRSARRERPPAAPVPQCSLFSAVSR

SEQ ID NO: 14111 - protein, 229 aa, Klebsiella pneumoniae
SGNFMENQPKLNSSKEVIAFLAERFPQCFSAEGEARPLKIGIFQDLVERVGGEMNLSKTQLRAALRLYTSSWRYLYGVKAGAIRVDLDGNPCGELEEQHIAHARQQLEEAKARVQAQRAAQQAKKREAAAAAGQQDEGVRRERKPRPQQPRRKEGAEQRKPRPVAAKAPREERLTPVSDVSVLTVGQALKVKAGNNAMDATVLEITKDGVRVQLTSGMSMIVRAEHLVF

SEQ ID NO: 14112 - protein, 597 aa, Klebsiella pneumoniae
DFHYTALQLHSSYQSRYSADSMASELKRDRRFIFRFYFALFLIFTNRQRGAKKVASHFAQLVLLPIVMHKTMHSLTGKDSVVEISYGRALWRNFLGQSPDWYKLALIIFLIVNPLVFAVAPFVAGWLLVVEFIFTLAMALKCYPLLPGGLLAIEALLIGMTSPAHVREEIAGNLEVLLLLMFMVAGIYFMKQLLLFVFTRLLLGIRSKMLLSLAFCLAAAFLSAFLDALTVVAVVISVAVGFYGIYHRVASARPDDSDLLDDSHIEQHYREVLEQFRGFLRSLMMHAGVGTALGGVMTMVGEPQNLIIAKAAGWHFGEFFLRMAPVTLPVMVCGLLTCLLVEKYRLFGYGEPLPPTVRKVLQEFDDRSRAQRSRQERLRLIAQALIGVWLIVALAFHLAEVGLIGLSVIILATTFTGVTDEHAIGKAFTEALPFTALLTVFFSIVAVIIDQQLFTPVIEFVLQASPHAQLSLFYLFNGLLSSISDNVFVGTVYINEAKAALEHGAISLPQFEMLAVAINTGTNLPSVATPNGQAAFLFMLTSALAPLIRLSYGRMVWMALPYTIVLTLVGLLCVEFTLMPVTDWLLAHGWLVTPSLP

SEQ ID NO: 14113 - protein, 349 aa, Klebsiella pneumoniae
ILCYLTCYLTSSVGMRQHGKVSEVTEKKTAVYVDDQQRILIRQLARSWLWRSELPTWLLIVTVYGGWFACVAGWRTLGLFPATLLLIWFTAWYMSLQHELIHGHPTRLAWFNQLLGTLPLAVWYPYGVYRDSHLAHHRNHLLTHPEDDPESYYVTAESWQRFSAWQRRLIHLRNTFWGRLLLAPMMDIIHTLNSALRAFREGDRRAIAMWSLHLLLLTGLLTWMAAQGFSPLWFVLAVSYPALALTKVRSFLEHRAADDPLARSVINEAGLPWRVLFLNLNYHAVHHDLPGVPWYALRQLYLHRQAAYLQRNQGFLVRGYGEWRRHFSRRAVAVNAHPGFGEQAGGEHG

SEQ ID NO: 14114 - protein, 465 aa, Klebsiella pneumoniae
RSIYASTSEQGAPLARRRIKLTRLSPGCLLHTLDGFDTEGIKTQLEGFRREQRQLQTAVAGLFAFRAEDRAVLVEAGEQARQIVEVGAHHVRRPFASDHGEGLFKLQQARGQLSFAIFGDDHRRVDHRVFVDAGFAEHGEHAGIGILHIRRGVAFERQHIIPVEDVVGGAVFRQVGIFNRADTHHFRQIFQLVSRHIRVLLGHQATGALQRFVQQIRQLHGTAGAGFKRLAVFPQHHTEHMVLQRHGVRHVACLAHDGPRLHQVLVLTRVDVVEHAVGVQRFIAILRTGDIGGGIEVAAILFLDDDAHRFAFLVFVLIKEDHGGAFALNRQPFGFQIGDDPRQHRVVQALTHHVIAGQGDVQAIVGDLVLRHGDVDQLTPHLQEVLITALQLNHVAARALGEGFVFVIVLFRFAIETFEVGQGHFAGVFLLLFFQIRDQHTELGAPVADVVGADHLMTQELQGTD

SEQ ID NO: 14115 - protein, 265 aa, Klebsiella pneumoniae
GGCYAKTINLDPQAEPEIYGAIRRNALLENVVVRADGSVDYADGSKTENTRVSYPLSHIDNIVKPVSRAGHPSKVIFLAADAFGVLPPVSRLTTEQMQYHFLSGFTSKLAGTERGITQPTPTFSACYGAAFLLLHPTQYASVLAAKMAESGAEAWLVNTGWNGEGKRLSLRDTRSIISAILNGTTGPLREETIPVFGLAIPQSIPGVDSAVLDPRNGWSSADKWQEKAESLAQLFMDNFKQYSDTEAGARLALAGPQLQKSAVEA

SEQ ID NO: 14116 - protein, 306 aa, Klebsiella pneumoniae
LPRYWGRLAGGSFAFAGIALTPPSFRDPLLGKLGRLVGRLAKSSRRRAQINLLYCFPEKSEYEREAIIDAMYASAPQAMVMMAELGLRDPQKILARVDWQGKAIIDEMQRNNEKVIFLVPHAWGVDIPAMLMASGGQKMAAMFHNQGNPVFDYVWNTVRRRFGGRMHARNDGIKPFIQSVRQGYWGYYLPDQDHGAEHSEFVDFFATYKATLPAIGRLMKVCRARVVPLFPVYDGKTHRLTVLVRPPMDDLLDADDTTIARRMNEEVEVFVKPHTEQYTWILKLLKTRKPGEIEPYKRKELFPKKK

SEQ ID NO: 14117 - protein, 600 aa, Klebsiella pneumoniae
VKGYLMRTEYCGQLRQSHVGQQVTLCGWVNRRRDLGSLIFIDMRDREGIVQVFFDPDRADALKLASELRNEFCIQVTGTVRAREEKNINADMATGAIEVLASDLTIINRSESLPLDSNHVNTEEARLKYRYLDLRRPEMAQRLKTRAKITSFVRRFMDDHGFLDIETPMLTKATPEGARDYLVPSRVHKGKFYALPQSPQLFKQLLMMSGFDRYYQIVKCFRDEDLRADRQPEFTQIDVETSFMTAPQVREIMEAMVRQLWLEVKGVDLGEFPIMTFAEAERRYGSDKPDLRNPMELVDVADLLKSVEFAVFAGPANDPKGRVAALRVPGGASLTRKLIDEYGNFVKIYGAKGLAYIKVTERAKGMDGINSPVAKFLTAEIVEAILDRTGAQDGDMIFFGADNKKVVADALGALRLKLGKDLSLTDEGKWAPLWVIDFPMFEDDGEGGLTAMHHPFTSPKDMTADELKAAPEEAVANAYDMVINGYEVGGGSVRIHRGEMQQTVFGILGINEQEQREKFGFLLDALKYGTPPHAGLAFGLDRLTMLLTGTDNIRDVIAFPKTTAAACLMTEAPSFANPAALGELGIQVVEKEAKASLENK

SEQ ID NO: 14118 - protein, 68 aa, Klebsiella pneumoniae
SGSYFTDLNQVQTTNNNGRMPKSSPNVFTLCGFTAANEGEGFREIRKHSTVQCKKITNIAWQKHQTIN

SEQ ID NO: 14119 - protein, 892 aa, Klebsiella pneumoniae
VAFQRVDRYIHQPFKHRRRVGAEGHHIGIALDNLIAAFHPGNAIALVQQRIHCGVEAEGHAGLLRHRRQTGGKQLAVAGFIIWQTQAAGQFVADLRQRRLHFRQPLRFQQLIRHAGVLQHRDVAGGIFILFGGTEQLQRPALAPFILNAGGVAQRLQAVAAVLRQAHHTAFVLHIVAGVAVAQHLPHPLQLERGAVKTDRQRRMALKHPFDRLQRHPRRRPGRRIAGRNLPGVGRAGLLCRTGLTVDDRHVMTRLTQITRAGYPNHPTSQYDDTHSDSVTVKEQSSNYKLITQLKILFNIRFIYGDLTHSKPHQPCAVRFTISCCALFLPSIKFCKQGKKTALRWGNREEKRLAYSTVCCTVFYACLEVFRSEKTNNNEGALMATIDSMNRDTTRLSDGPDWTFELLETYLAEVDRVAKLYRLDTYPHQIEVITSEQMMDAYSSVGMPINYPHWSFGKKFIETEQAYKHGQQGLAYEIVINSNPCIAYLMEENTITMQALVMAHACYGHNSFFKNNYLFRSWTDASSIIDYLIFARKYITECEERYGVDEVEKLLDSCHALMNYGVDRYKRPQKISLQEEKARQKSREEYLQSQVNMLWRTLPKREEEKAIESARRYPSEPQENLLYFMEKNAPLLEPWQREILRIVRKVSQYFYPQKQTQVMNEGWATFWHYTILNHLYDEGKVTERFMLEFLHSHTNVVFQPPYNSPWYSGINPYALGFAMFQDIKRICQSPTEEDKYWFPDIAGSDWLETLHFAMRDFKDESFISQFLSPKIMRDFRFFTVLDDDHNNYLEISAIHNEEGYREIRNKLSAQYNLSNLEPNIQVWNVDLRGDRSLTLRYVPHNRVPLDKGRREVLKHVHRLWGFDVLLEQQNADGSIELLDRCPARPNAL

SEQ ID NO: 14120 - protein, 84 aa, Klebsiella pneumoniae
LMSQHLTEHDELVSDVVACQLVIKQILDVIDVIAPVEVREKMTTQLKAIDFASHPASADPVTLRAVQKAIALIELKFTPQEETH

SEQ ID NO: 14121 - protein, 710 aa, Klebsiella pneumoniae
TRHHSGATLRPECSCVTIKQQKNNMPPKAKRIPHAMTLHGDTRIDNYYWLRDDERARPDVLEYLHAENAYGKQVMDSQLSLQERLLKEIIDRIPQREVSAPYSKNGFRYRQVYEPGCEYAIYQRQSVLKEEWDEWEILLDANQRAAKSEFYTLGGLGIAPNNQLMAVAEDYLSRRQYGLRFCDLSNGEWYPEILENVTSGFAWSNDSRFVWYVRKHPTTLLPYQVWRHTVGTPAQSDALVYEEKDETFYVSLHKTTSQQFVVIYLSSATTSEVLLLNAELPDAEPVCFLPRRKDHEYSLDHYQHAFYLRSNREGKNFGLYRTVLRDEEQWTTLIPPRHDVMLEGFTLFTDWLVVEERQRGLTSLRQINRKTREVVGIAFDDPAYVTWLAYNPEPETSRLRYGYSSMTTPDSLFELDMDTGERRVIKQQEVKGLDTSCYQSEHLWVTARDGVEVPVSLVYHREHFRKGSNPLLVYGYGSYGESIDADFSASRLSLLNRGFVYAIAHVRGGGELGQQWYEDGKFLCKKNTFNDYLDVCDALLAQGYGDPRLCYGMGGSAGGMLMGVAVNERPELFHGVIAQVPFVDVVTTMLDETIPLTTGEFEEWGNPQDETYYHYMKSYSPYDGVRAQAYPHMLVTTGLHDSQVQYWEPAKWVAKLRELKTDDNLLLLCTDMDSGHGGKSGRFKSYEGVALEYAFFIALAQGTLPGKAAV

SEQ ID NO: 14122 - protein, 268 aa, Klebsiella pneumoniae
TRGHLPQYMSDYNMPFSLRNITALRRLINSKLSKARMSNTPIELKGSSFTLSVVHLHDANPEVIRQALEDKIAQAPAFLRHAPVVVNIASIEEEVEWRAINEAIAATGLRIMGVSGCKIPRLKTEIDRAGIPLLTEGKEKASRPAPSEPTPPPPVASQITKTRLIDQPVRSGQRIYAPHCDLIVTNHVSAGAELIADGNIHVYGMMRGRALAGAGGDRDAQIFCTHLAAELVSIAGEYWLSDNIPAEFYGKAARLRLGESALAIQPLN

SEQ ID NO: 14123 - protein, 179 aa, Klebsiella pneumoniae
PKRQASPIRRRSVSWVFRLWRKRQKRLWRTSNMSFKLPVSVLVVIYAEDTKRVLMLQRRDDPAFWQSVTGSLEAGETALQAAAREVKEEVAIDVACEQLTLIDCQRTVEFEIFSHLRHRYAPGVERNTEFWFCLALPHEREITFTEHLAYRWVSATEAAALTKSWSNRQAIEEFVINAA

SEQ ID NO: 14124 - protein, 91 aa, Klebsiella pneumoniae
EQQQRGGGNIRLRPCLSLTVKGEERRKIVAHGLSSDQNMTQAGVFVRHLSGQLCVVFPVNNVSDGLRQLNQRVDIQRPLRGHRQHGDNAQS

SEQ ID NO: 14125 - protein, 916 aa, Klebsiella pneumoniae
EAEHMAKLLKAMKRPAALWGVPMVPLLAVTGVTIIVAIWTSVALLFLLPVQFLVMKSLTRNEPMRFNLIAVWLRAKGKPVANRLFGATTFMPVEHDDVDIKEFLDAMKLNQCATIKKYIPYSSHIHQHVVRSPKSDLYCTWELMGTPFDCESDESLQFGTNQLHGLIRSFEGMPVTFYIHNDRNTFTDNLHKDSGNPYADEVSRLYYASVGLFRRNRLFLTVCYRPFVSLEKAERKRMKDSQKLKELDGALLEMLEIKSTLDTALSRYGARPLGTFTEGNAVFSSQLAFYEYLLTHQWRKVRVTRTPAYDVMGAAALFFSAESGQINHANGTQYFRGLEVKEFAEETATGMMDSLLYAPCDYVITQSYTCMSREEAKKAIKRTRRLLMSADDDAVSQRLDLDVALDLLTSGKIAYGKHHFSIMVYSPSLESLVADTNEISNALNNIGITPVPAEISLSAAYMAQLPGNYNLRPRKGELSSQNFVELAALHNFYPGKRDKAPWGDAMALLRTPSGDGYYINLHNTLADKDEFNEKNPASTCILGTNGSGKTMLMTFFEIMQQKYGREDSFSPDAKTKRLTTVYLDKDRGAEMNIRALGGRYYRVISGESTGWNPFSLPATKRNINFIKQLMKILCTRNGSTISPRDERRLSDAVNAVMNDEPQYRVYGITRMLENLPEPATKEAQENGLSIRLSQWAQGGEFGWVFDNESDTFDISNCDNFGIDGTEFLDDASVCAPISFYLLYRITSLLDGRRLVIFMDEFWKWLRDPVFKDFAYNKLKTIRKLNGMLVVGTQSPAEIIKDDIAPAVIEQCGTQILAANPNADRAHYVDGMKFEPEVFDVVKGLDPQARQYVVVKNQFKRGDTKRFAARVTLDLSGIGRYTKVMSGDAPNLEIFESIYREGMQPHEWLDTYLAKAL

SEQ ID NO: 14126 - protein, 73 aa, Klebsiella pneumoniae
GILQMAKIKGQVKWFNESKGFGFITPADGSKDVFVHFSAIQGNGFKTLAEGQNVEFEIQDGQKGPAAVNVTAI

SEQ ID NO: 14127 - protein, 893 aa, Klebsiella pneumoniae
LFLQLNGWTAAYFGTHMSQETPASQTEARIKTKRRISPFWLLPVIALLIAAWLIWTSFDDRGSTITIDFQSANGIVPGRTPIRYQGVEVGTVQDISLSKDLSKIEVSASIKRDMKDALRKETQFWLVTPKASLAGVSGLDALVGGNYIGMMPGKGEPEDHFVALDTQPKYRINNGELMIHLQAPDLGSLNSGSLVYFRKIPVGRVYDYSLNANNQGVTIDVLIERRFTNLVKKGSRFWNVSGVKADVGLSGAKVQLENLSALVNGAIAFDSPADSHVASQNDEYHLYEDLAHSQRGVVVTLDLPDGDGLKAGSTPLMYQGLEVGQLSKLNLNPGGKVTGEMTVDPSVVTLLREKTLIQMKKPKLSLDNPSISTLLTGNTFELVPGEGEPRNHFSVMPADKALLDEPNVATVTLSAPESYGIDGGQPLVLHGVKVGQVLERKLTAKGVTFQVAIDPEYRDLIHGDSKFVVNSRLDVKVGLDGVQVLGASASEWVNGGIRVIPGEKGKMQSSYPLYANLEKAQENSLSEVPTTTLSLSAETLPDVQAGSVVLYRKFAVGEIIAVKPRKDAFDIDLHIKPEYRYLLTNNSVFWAEGGAKVKLDGNGLTVQASPLARAIKGAISFDNLNGSSAGARLNNKRILYASETAARAVGGQITLHAYDAGKMAAGMPIRYLGIDIGQIQSLELITAKNEVQAKAVLYPEYVGTFARAGTRFSVITPQISAAGVEHLDTLFQAYINVEPGRGPARRDFEIQDTTISDSRYIDGLNIVVEAPEAGSLGIGTPVLFRGLEVGTVTGLSLGSMSDRVMVKLRISKRYQYLVRNNSVFWLASGYSLDFGLIGGVVKTGTFNQFIRGGIAFATPPGTPLAPKAQDGKHFLLQESEPKEWREWGTALPQ

SEQ ID NO: 14128 - protein, 307 aa, Klebsiella pneumoniae
RCLQRRLRRAASGQHDAYFPAHRPGAQYRGDPHGAMIYIGLPQWSHPKWVRLGITSLEEYARHFNCVEGNTTLYALPKPEIVARWYEQTHDDFRFCFKFPATISHQAALRHCDELSSEFFARLAPLASRIGQYWLQLPATFGPRDLPALWHFLDGLPKDFTYGVEVRHPEFFAKGEAEQQLNRGLHERNVNRVILDSRPVHSAAATSPAMIDAQQKKPKVPVHAVMTARQPMVRFIGGDDMAHNRELFRVWLQTLAKWHQSGTPWLFLHTPDIAFAPALVDTLWGDLRAALPAAGNAPSIPQQSSLF

SEQ ID NO: 14129 - protein, 210 aa, Klebsiella pneumoniae
TITQEPHVIGRLRGIILEKQPPLVLLETAGVGYEVHMPMTCFYELPEAGQEAIVFTHFVVREDAQLLYGFNNKQERTLFKELIKTNGVGPKLALAILSGMSAQQFVNAVEREEVASLVKLPGIGKKTAERLIVEMKDRFKGLHGDLFTPAADLVLTSPAGPTADDAEQEAVAALVALGYKPQEASRMVSKIARPDANSETLIREALRAAL

SEQ ID NO: 14130 - protein, 391 aa, Klebsiella pneumoniae
LYAQNTWCSETEAGPGMNTFFKITALAGLLAIAGHAFAVDDITRADQIPVLKEEPQHATVSERVTSRFTRSHYRQFDLDNAFSAKIFDRYLNLLDYSHNVLLASDVAKFAAKKDQIGDELRSGKLDVFYDLYNLGQQRRFERYQYALKVLERPMDFTGNDNFNLDRSKAPWPKDEAELNKLWDAKVKFDQLSLKLAGKDDKEIRDTLTRRYKFAIRRLAQTNSEDVFSLAMTAFAREIDPHTNYLSPRNTEQFNTEMSLSLEGIGAVLQMDDDYTVINSLVAGGPAAKSKAISVGDRIVGVGQTGKSMVDVIGWRLDDVVALIKGPKGSKVRLEILPGRKGAKTRIVTLTRERIRLGDPAGEDVGEKPAGKEKVGGAGYFQAFYRWPDPMT

SEQ ID NO: 14131 - protein, 189 aa, Klebsiella pneumoniae
AQAHLMLILVGCTYQAVRQQSEDIMSKTEFYADLNRDFQALMAGETSFLAMIANTSALLFERLSEVNWAGFYLLEGDTLVLGPFQGKLACVRIPVGRGVCGAAVAQAQVQRVEDVHAFDGHIACDAASNSEIVFPLRVNGQIIGVLDIDSPAYGRFTAEDEQGLRTLVEHLEKLIAATDYQKIFTRVVG

SEQ ID NO: 14132 - protein, 70 aa, Klebsiella pneumoniae
RSKHRHRGASCSFSAAVCATSPLRIALTSASEQWGKSPPQTEYQASQPACNPAVAHASPLTPSVTREGRC

SEQ ID NO: 14133 - protein, 455 aa, Klebsiella pneumoniae
RIWQGTRRRWFHRIPAGGKSGKTGIQLTYKNIFIKGNVHMNDENKMPVPDEAQAFPAHAEDDIATLEREARAKREAELLNAQDDEEKDPVQPAVNKLKKRKRGKATAFLAIVAVTLIFLAWGGNWVYRNILWQPTEEKKQDTAPQTNKTDYRQRNDLGMSTDTAEEEPEQQDNGQSSTGGTGQVAPAAPPELNKASFLIRRDGSATTQNPVKTRQQEMTLTSATTTGQQDSSAATNTAAPPPGQSPAPLRRIPYNPDLYIPENTSIPCSLDRRFVSDRAGKLRCTVTTDIWSASGNTKLIEKGTTASLLYRAIAEEGMKHGQGRAFIIATKLRTRQPPYLDIPLVDTSAAGELGEAGVDGWIDSHFWERFGGALMVGMIPDIGAWASNSAGKKDRNTDYTENSRQAMADMARTTLENSINIPPTLYKNQGEIINLITGEDIDFSNIYTLRLKNDR

SEQ ID NO: 14134 - protein, 135 aa, Klebsiella pneumoniae
RERHIMAVLPQPNGMLKEEKAMTITRIDAEARWSDVVIHNQTLYYTGVPANLDADAFEQTANTLAQIDAVLEKQGSDKSRILDATIFLADKSDFAAMNKAWDAWVVAGHAPVRCTVEATLMNPQYKVEIKIIAAV

SEQ ID NO: 14135 - protein, 441 aa, Klebsiella pneumoniae
LFFNCYGVAMRVVILGSGVVGVASACYLSQAGHDVTVIDRQPGPAEETSAANAGQISPGYAAPWAAPGVPLKAIKWMFQRHAPLAIGLDGTSFQLKWMWQMLRNCDTRHYMENKGRMVRLAEYSRDCLKALRDTTGIQYEGRQGGTLQLFRTAKQYENATRDIAVLEDAGVPYQLLEAKRLAEVEPALAEVSHKLTGGLRLPNDETGDCQLFTTRLAAMAEQAGVTFRFNTAVDALLHEGDRIAGVKCGDEIIKGDAYVMAFGSYSTAMLKGLVDIPVYPLKGYSLTIPIAQEDGAPVSTILDETYKIAITRFDQRIRVGGMAEIVGFNKALLQPRRETLEMVVRDLFPRGGHVEQATFWTGLRPMTPDGTPVVGRTAYKNLWLNTGHGTLGWTMACGSGQLISDLISGRTPAIPYDDLAVARYSPGFTPARPQHLHGAHN

SEQ ID NO: 14136 - protein, 543 aa, Klebsiella pneumoniae
KVLNKVQSGILYELTTVKGDDSMNRMTIPLGDILTQSGHHRAGNRELPVLSITMKNGLVDQSDKFKKRIASSDTSKYRIVYKNELVVGFPIDEGVLGFQTKYPVGIVSPAYGIWKLKDESVCHIPYLERYLRSSEARRLYASRMQGVVARRRSLTKSDFLSLEVPFPPINDQARIANLLAKVEGLIEQRKQLLQYLDDLLKSVFVDMFSDPVKNAKGWELTTIGELAVDVRYGTSVSAQGGKYKYIRMNNITPDGYWDFENLKYIDVDNKDLDKYSLQKGDLVFNRTNSKELVGKTAVYDRDETVIIAGYLIRVRFDQQTNPWFVWGHLNSKFGKAKLFNLCRNIIGMANINAQELRAIPILKPPLELQNKFATIVEKAHAIKFRYQQSLADLETLYDVVSQKAFKGELELSRVPIPTQIFFPVSGEEPEHGDAVQHIAVGNYLPVTNSLPSALDNAEARKSLIEEWLEAYIAQLGNSSFSVHEFMMTAQARLAELYPDVDSKFGESDYEHIKAWVFKALAIGTLKQVFNDADNCIELKAVLV

SEQ ID NO: 14137 - protein, 584 aa, Klebsiella pneumoniae
YNVNKMYYPGAVMTTNNYFRGDAVKKVWLNRYPADVPAEINPDRYQSLVELFEHATTRYADQPAFINMGEVMTYRKLEERSRAFAAYLQEGLGLQKGDRVALMMPNLLQYPVALFGILRAGMIVVNVNPLYTPRELEHQLNDSGAAAIVIVSNFAHTLEKVVAKTQVQHVILTRMGDQLSTAKGTLVNFVVKYIKRLVPKYHLPDAISFRSALQHGYRMQYVKPEIVAEDLAFLQYTGGTTGVAKGAMLTHRNMLANLEQVNATYGPLLHRGKEFVVTALPLYHIFALTMNCLLFIELGGQNLLITNPRDIPGLVKELAKYPFTAMTGVNTLFNALLNNKEFQQLDFSSLHLSAGGGMPVQQAVAERWVKLTGQYLLEGYGLTECSPLVSVNPHDIDYHSGSIGLPVPSTEAKLVDDDDNEVAPGQPGELCIKGPQVMLGYWQRPDATDEIIKDGWLHTGDIAVMDEEGFLRIVDRKKDMILVSGFNVYPNEIEDVVMQHSGVLEVAAIGVPSGSSGEAVKIFVVKKDAALTEEALITFCRRHLTGYKVPKLVEFRDELPKSNVGKILRRELRDEARAKVDNKG

SEQ ID NO: 14138 - protein, 166 aa, Klebsiella pneumoniae
PTSNTVMAMNGTITTWFKDKGFGFIKDENGENRYFHVIKVANPDLIKKDAAVTFEPTTNNKGLSAYAVKVIPESKYIYIAGERLKLTSIKSYVVYREEEPVETRVDKENAVLSVGLLMNSIRPKATVQPGEMRSVKKLAITTFQGTTLIFSEDEIDIDATVKLLKV

SEQ ID NO: 14139 - protein, 178 aa, Klebsiella pneumoniae
PAGNGQHAHAHRHGGHLLRRTGKTAGGGGRDNQQGSDDQRPDELHRHADSQGGDQHQQQLDPLQLHAVDKRKVRTDGHRQQISPLPEQNANHNHHASGNGDQVLRRNRQQIAEQVRHQIDADVRHQTDHHQPQGQRAVRHDAQQGIDRQMRSFFQPHQPAGQQQGHGDHRIERIDVKQ

SEQ ID NO: 14140 - protein, 274 aa, Klebsiella pneumoniae
DLINRRSTMEITLLQIVLVFIVACIAGMESVLDEFQFHRPLIACTLIGAVLGDMKTGIIIGGTLEMIALGWMNIGAAVAPDAALASIISTVLVIAGHQSIGAGIALAIPLAAAGQVLTIIVRTITVAFQHAADKAAENGNLTALSWLHVSSLFLQAMRIAIPAVIVAISVGTSEVQGLLNAIPEVVTSGLNIAGGMIVVVGYAMVINMMRAGYLMPFFYLGFVTAAFTNFNLVALGVIGAVMAILYIQLSPKYNRVAGAPAQAAGNNDLDNELD

SEQ ID NO: 14141 - protein, 360 aa, Klebsiella pneumoniae
SFPNTTRPARVKLHAYCALAGQNDAGKANRQAIRRRKSHTDGEKTMTISLYTSRTSAPNTAAATSVSSLEQSGSSKTKFSKTRTDIYQTVTDSIIAALEAGVKPWSCPWLRVSGMSGLPSNYATGTAYSGMNIMLLWCSASKQGFSDSRWMTYKQAQAAGGQVRKGEHGTTAIFYTTLEKENDAGEVEQIPMLKTFTVFNVQQIDGLPLTTETVSPEATFNPLPQAENLLRKSGANIIEKGQNAFFSPSTDEVWLPERHLFSDAANFYATGLHELVHWSGGKKRLNREMKGKFGSADYAEEELVAELGSAFLMADLGIEGEVQHESYIASWLKALKNDKRYIFKAVSAASKAHSYLMDKL

SEQ ID NO: 14142 - protein, 649 aa, Klebsiella pneumoniae
YCCFPTDSSGKWGTIRNCWRRAACINGSGNTISRRSIGCRVEHRKRWWKMKDNNPADNLAWRVNWRQLISSVGSQARMLRRSMLALLLAAFMQGIAFACLYPIIDALLRGDAPQLLNWAMAFSVAAIVTLVLRWYGLGFEYRGHLAQATHELRLRLGEQLRRVPLEKLQRGRAGEMNALLLGSVDENLNYVIAIANILLLTIVTPLTASLATLWIDWRLGLVMLLIFPLLVPFYYWRRPAMRRQMQTLGEAHQRLSGDIVEFAQGMMVLRTCGSDADKSRALLAHFNALENLQTRTHRQGAGATMLIASVVELGLQVVVLSGIVWVVTGTLNLAFLIAAVAMIMRFAEPMAMFISYTSVVELIASALQRIERFMAIAPLPVAEQSEMPERYDIRFDNVSYRYEEGDGHALNHVSLTFPAASMSALVGASGAGKTTVTKLLMRYADPQQGQISIGGVDIRRLTPEQLNSLISVVFQDVWLFDDTLLANIRIARPQATRQEVEEAARAAQCLEFISRLPQGWLTPMGEMGGQLSGGERQRISIARALLKNAPVVILDEPTAALDIESELAVQKAIDNLVHNRTVIIIAHRLSTIAGAGNILVMEEGQVVEQGTHAQLLSHHGRYQALWQAQMAARVWRDDGVSASGEWVHE

SEQ ID NO: 14143 - protein, 73 aa, Klebsiella pneumoniae
GEYNVPDEIDRDQAFNERCLEVLIEQSRLRPTPTPSLQHCRLCGKAIPEKRRQTLPGVTTCTDCQSILEKRRR

SEQ ID NO: 14144 - protein, 527 aa, Klebsiella pneumoniae
PCRKPESYMELLMDPSIWAGLLTLIVLEIVLGIDNLVFIAILADKLPPKQRDKARLIGLSLALVMRLGLLSVISWMVTLTKPLITIADFSFSGRDLIMLLGGIFLLFKATTELHERLENRQHDAGHGKGYASFWVVVLQIVVLDAVFSLDAVITAVGMVNHLPVMMAAVVIAMILMLLASKPLTRFVNQHPTVVVLCLSFLLMIGLSLVAEGFGFHIPKGYLYAAIGFSIIIEFFNQVARRNFVRHQSTLPLRARTADAILRLMGGRKQASVSHDADSPAAVPVPEGAFAEEERYMINGVLTLAQRSLRSIMTPRGEISWVDAEQSEDEIRRQLLSSPHSLFPVCRGELDEIIGIVRAKEMLVALESGENVAALASASPAIVVPETLDPINLLGVLRRARGSFVIVTNEFGVVQGLVTPLDVLEAIAGEFPDADETPEIVIDGDGWLIKGSTDLHALQQALGLDPLINDDEDIATVAGLVISANGHIPRIGDVVSLPPLHFTVVEANDYRVDLVRAVVTRPPSDEEE

SEQ ID NO: 14145 - protein, 68 aa, Klebsiella pneumoniae
IVGKWKKYPTHTECVEFYYSATVPRVTILSCSYPQDPLTRTSNPFPVNKDIFYGSSRNGTKAKHPNES

SEQ ID NO: 14146 - protein, 640 aa, Klebsiella pneumoniae
  UNSURE (586): Identity of amino acid at the above locations are unknown.
PGGNVIDDFAADGQLAKAIPGFKPREPQRQMAVAVSEAIEASRPLVVEAGTGTGKTYAYLAPALRAKKKVIISTGSKALQDQLYSRDLPTVAKALKFTGKLALLKGRSNYLCLERLEQQALAGGDLPVQTLSDVILLRSWSNQTQDGDISTCASVAEDSQAWPLVTSTNDNCLGSDCPLYKDCFVVKARKKAMDADVVVVNHHLFLADMVVKESGFAELIPEAEVMIFDEAHQLPDIASQYFGQSLSSRQLLDLAKDITIAYRTELKDTQQLQKCADRLAQSAQDFRLQLGDPGYRGNLRELLADSHIQRALLLLDDALELCYDVAKLSLGRSALLDAAFERATLYRGRLKRLKEINQPGYSYWYECTSRHFTLALTPLTVAEKFKEVMAQKSGSWIFTSATLSVNDDLHHFTARLGIDEAQTLLLPSPFDYQHQALLCVPRNLPLPNQPGAARHLAAMLKPLIEANDGRCFMLCTSHAMMRDLAEQFRATMTLPVLLQGETSKGQLLQQFVSAGNALLVATSSFWEGVDVRGDALSLVIIDKLPFTSPDDPLLKARMEDCRLRGGDPFDEVQLPDAVITLKQGVXRLIRDIDDRGVLVICDNRLVMRPYGAVFLASLPPAPRTRDIRRAVRFLAVPPAR

SEQ ID NO: 14147 - protein, 474 aa, Klebsiella pneumoniae
SMLNSSFKKPYHLRLIFTMDKNSSDGVPLPQRYGAILTIVLGLTMAVLDGAIANVALPTIASDLNASPAASIWIVNAYQIAIVIALLPLSFLGDMVGYRRIYKIGLVVFIFTSLACALSRSLEMLTFARVAQGLGGAALMSVNTALIRLIYPQRFLGRGMGINSFVVAVSSAAGPTIAAAILSLASWQWLFLINVPLGIVAFVLAMRFLPPNSARSKIIRFDLPSAIMNALTFGLLITALSGFAQGQSTQLVLAEVAAMLVVGFFFVRRQLTMPVPLLPVDLLRIPLFSLSICTSICSFCAQMLAMVSLPFFLQSMMGRSEVETGLLLTPWPLATMVMAPLAGYLIEKCHAGLLGAIGLLIMACGLFGLALLPSSPSDLDIIWRMALCGAGFGLFQSPNNHTIVASAPSHRSGGASGMLGTARLLGQSTGAALEALLFNLLGNNGTHTALLLAGTLAIVAALISGLRVTQPRAA

SEQ ID NO: 14148 - protein, 581 aa, Klebsiella pneumoniae
IWLKMRKGTCDGSIGADRPVTDRQRSGCLGFARFGRRHGVITRRRSLGGSRRRGGVLCGRLLLRQSANSQDMLQRFFTLSQPHRHGIALDVIHLQRRCHQPVIQHLCQIEHFVVSVGLFFAGKRHFFLTFADHHIFNFNRHTAASQHCIFIQYSKFPSRTQLTRVTRVKTYANVFVYNRCHLFLLRMRVMTVLGTALRPAATKVMLLGSGELGKEVAIECQRLGIETIAVDRYPDAPAMQVAHRAHVINMLHGESLRALIEQEKPDYIVPEIEAIATDTLVELEQAGQKVVPTARAAKLTMNREGIRRLAAEELQLPTSRYRFADSEEGFRAAVTEIGLPCIVKPVMSSSGKGQSFIRSADQLREAWRYAQQGGRAGAGRVIVEGVVNFDFEITLLTVSAVDGVHFCAPVGHRQEDGDYRESWQPQQMSDLALERAQTIARKVVLALGGYGLFGVELFVCGDEVIFSEVSPRPHDTGMVTLISQDLSEFALHVRAFLGLPVGAIRQYGPAASAVILPQLSSQNVSFGQLQSAVGAGLQLRLFGKPEIDGTRRLGVTLAVADSVEEAVARAKAAAAAVIVEG

SEQ ID NO: 14149 - protein, 537 aa, Klebsiella pneumoniae
RNIKTVFQKYKTRGLFFMARYTASASEGLQGRPILLRHQLAYGGGNLLGSGALAISGAWLLYFYTTFCGLTLIEASFIFSVASIIDAISNPLMGYLTDNFGKTRLGKRFGRRRFFLLIGIPLMMFYPLLWVEGLSFWYYLSTYVVFEIIYTSIMVPYETLATEMTDDFSLRSKLTGYKAIFGKLANFLAAFIPGQFILLYGKDSATPFFLTGLTYGAILIVAISCLWLCSWERERGEEVETSAKKGLLSTLLSLAKDMRSTFYLRVFRKHLGMYLCGFGAEWLFASIFTYFVIFVLQHDPAMVAGLNSLNSILQLISTALFIGLCVKKGFSKPYILALGIVIFAVLLYTSLWFFHLPSGLATVLMFGITVLFGLGTGGVYYIPWTVYTFLADVDEIYTGRRREGIYAGAMTFSGKILRSIVVFSMGAILSFYGFQSKAHSQPESAVTAIAVVFCVGVIALALAAIVFSKQMKLDRKAHLVVLQEVARIKAGGKISDIAPDVRVIVEDLVGHRYEECWGNSKLFKDAAPAPAQTVVSH

SEQ ID NO: 14150 - protein, 427 aa, Klebsiella pneumoniae
MPIKTPTLKPAKKMVVHTVSTPLPYAHYQRCTQCDMLFRLPVLKRNQSAWCPRCNAKVRDGRDWSLTRLGSMALAMLLLMPFAWSEPLLRLHLLGVRIDANVLQGIWQMTAQGDPITAAMVLFCAVVAPVLLVVSISYLWLGNVLGMNLRPVLLMLGKLKEWVMLDIYLVGIGVASIKVQDDAFLQPGIGLVAFISLTLLSILTLIHMNVEELWERFYPERPATRADNNLQVCTGCHYTGYRDARGRCRRCHTPLHHRRPQSLQRSWAALIASLVFLFPANLLPISIIYVNGARQDDTILSGIISLASSNIAIAGVVFIASILVPFTKVIVLFTLLLSIQFKCEQGLRTRILLLRLITWIGRWSMLDLFVISLTMSLINRDQLLAFTMGPAAVYFGGAVILTILAVEWLDSRLLWDAHESGNARFAD

SEQ ID NO: 14151 - protein, 91 aa, Klebsiella pneumoniae
KAINGAFRHHDALGQFGNANFTLFTQRLLDAENLQYRRDRIWLVIQFCTCHLSPRRTCLLKIRTGFYYKFAASEPQSFFCHFVTNLRHTAN

SEQ ID NO: 14152 - protein, 418 aa, Klebsiella pneumoniae
RIANPSSPVRLRNAPPLYIPSPDGGIGRHKGFKIPRRSRCAGSSPAPGTIGKYRIIKAISSVVKPPTGGFFVSVLSPSDTFPASLTPRRFSVNSCLTVNFSFVPGQNDRALLLSNGLSAQPAGGSMFSGLCAFPLTPLHQQKFDEKAFIRILARLTDAGVDSLGILGSTGSYAYLSREQRRRVVQVAKAHAGSIPMMVGVGAIATNEVLRLVEDAQEAGADALLLPMMSYQPLSAEEIFAFYEEVCRHVSVPVCLYDNPRTTHVMLADELQGRIAALPAIASIKIPGLPAPQASERVAALRQHLPSRVTLGVSGDAWATAGLQAGCEAWYSVCGGLFPHCSLALVRAIRSGDVAQTAALNEQLAPLWRCFDRYGGSLRVIASAAAMLGLCDPDSLPRPLLSLGEEACREVASALRGLA

SEQ ID NO: 14153 - protein, 259 aa, Klebsiella pneumoniae
HAAKVVWIRERGMAVLEVCCYSMACAREAERCGADRIELCAAPQEGGLTPSYGVLVSAREAITLPVHPIVRPRGGDFCYTEEEFAAMLNDIRMVRDLGFPGLVTGVLDADGQIDIPRMKKIMAAAGPLAVTFHRAFDLCADPRQAWKTLGELGVKRILTSGQQSSAEKGISLITELIAAGDTPIIMAGAGVRAANLPLFLQAGVKEVHSSAGHWLPSEMRFRHPGVSMSADPDADEYRRYAVNGAAVAEMKRIISAWRS

SEQ ID NO: 14154 - protein, 64 aa, Klebsiella pneumoniae
FPANGQPAAMPPEVYWEPLINKMARSLTHFSADYLAGGTARKRTARRISRVRGAGGRLARNTAP

SEQ ID NO: 14155 - protein, 77 aa, Klebsiella pneumoniae
SYQNKNSQQCNIKNTTNKQSYIQGTSPEYKSTDKQPKKTTRINKTFTITHPQLKTISKTQRFHRQKQSLTHIFFEIL

SEQ ID NO: 14156 - protein, 467 aa, Klebsiella pneumoniae
INKNRATVSHGQEKAGMTQILGTGEGKTSSAAKEPVVERKPAQVFFESMALAASMSGYYAGPTATTLGNSLSLGAGTAAGVGEGVAGARVLAAPNPLTVALLAIFYSPSLNEGETETLQNIRGDQLYQNLIHGQMMVGAFTRVNSTVIQGDYVPEYELREIARQNGTVRTRVRFRIEEDPESGELVSRSYEVGEKSGLDRVRVRFAKQLDKETWGFEDPSIKGTFVWSRSAGQGRFEWGASQTTVHDGSAGGSTTPPTPIPEPRSVLGLPNPAPASLPPVPGTPIPEEQGPNIETLPIEDRDFNDFIIVDPMGGVPAIYVYFQKASVRDLEVDYYGNFEGRSRQGLYEVDHIPSKEAVRIYLKGTYPNLKDDIIEQMTDRVAAVAIPIEVHRQCNETYGGKNNSKFRTQDGGLVTQKVLDASNLEAAVDANWDANAECLRNEYGVSDEKIEEIRAKLHELNRKAGLY

SEQ ID NO: 14157 - protein, 86 aa, Klebsiella pneumoniae
EDKKQMEWWVKKVQDNASASVCRVVLQSGALEMIAEIEACRLRVREGDKLTPLADARYCLNNNPMQTLKIRNATHYSSERWTNAGK

SEQ ID NO: 14158 - protein, 302 aa, Klebsiella pneumoniae
MMKKLTFTALALMMCGAAWAAAIPQASRYDSRVQQVIYNPQNVTVVNTKPGFMTTLVFDNDEAVISAKPGFDEAWEATPDANRVNVRPVALTQGAPGEDGNTTQVVIPPNSRDWHTNMLVVTSKRLYNVELNVIDDKSAQQPAFQVSYRYPGEERDKASREATARQREWEQKQQQASVQKALNSAQTPRNWSYTKYPGKGSFNIVPDFAYDDGRFTFVGFSPSKSIPSVTKELNGKEHVVNSSIQKKGDFTVLVIQEVTPRLVLRSGNAVVGLENSGFGKVHAADGSTVSRQVERVEKPESN

SEQ ID NO: 14159 - protein, 144 aa, Klebsiella pneumoniae
MMKKLFFAGMVVALAGCVQVDRYEDVVIAPAPAGLAGFWQTKGPQSAMMSPDAIASLIVTKEGDTFDCRQWQRVIAQPGKLMNRDSEIYNVTASLDIYPVEREGNTISYDRMTLSRVERLTPECEKAWAKARATGPVSAPASTR

SEQ ID NO: 14160 - protein, 242 aa, Klebsiella pneumoniae
PSEKGKPMDLVDWQQRFERWILTHHAQDDAAHDLSHFRRVWATATQLAAGEEVDRLVLLTACYFHDIVSLPKNHPERSRSSMMAAEKTLAILQSAFADFPADRYPAVSHAIEAHSFSAAIPPRTLEAKIVQDADRLESLGAIGLARVFAVAGALNTILFDAEDPFADRRALDDRKYALDHFQCKLLRLPETMQTDKGKAMAQHNARFLVEFMAKLSAELQGEPLALDEAVLRRFAPQASTDR

SEQ ID NO: 14161 - protein, 418 aa, Klebsiella pneumoniae
CRRNASSDAQRVRCCRSWRDSFSQRNPAAAGAHQAARPPDHHHHHQHAEQQHPIFVKTAQQLRGDRQNKRRQYHSQGGAHSPEHHNRQDQRRLKKGERRRVNKPLIAGEEHPGDAGRRRAEHKRRELHQHVVEPHRPTGDLILAQRLPGAADGHPRQAMLHQQHQHHHQTQHGVEKDEFQVGVVADVEKLMDGDAAILGPAGKLEAKQRGGWHRYAVRAPGEAHPVVKHQADNFAKAEGDDGQIVAMHTQHRKTQQRPGEGRHHRPQRQHRPEAEAQVLVAQRQAVGADGVKRHIAQIEQTREAHHNIQPQAKQNVDQPKNGHGQQIFCGEKRKDNGQPHQQRYYPAQPRAVARRPDVHPVIRPLKAGNKGFSPVALQQQTERQPAGHHHRHQNRHPRRREGKTIPFEHHADDRAKDN

SEQ ID NO: 14162 - protein, 220 aa, Klebsiella pneumoniae
WALNPRRGRVFASRYRIRRPIVSLATRWWFRSSPRWRNSWRRASLRRWRAVKRMIMMADVHDKATRSKNMRAIATRDTAIEKRIAALLTGAGFTFVAQDRALPGRPDFTLPDYRCVIFTHGCFWHHHDCYLFKVPATRTAFWLDKIAGNVARDARDRQKLAEEGWRVLIIWECALRGRLRLSDAALTERLEEWICGAGHDAQIDTQGIRELTTTSTPYKE

SEQ ID NO: 14163 - protein, 169 aa, Klebsiella pneumoniae [sequence omitted]

SEQ ID NO: 14164 - protein, 269 aa, Klebsiella pneumoniae
LTLKCANTASRRSSNNTGITAMTYCVAMCLADGLVFASDSRTNAGVDHIATFKKLHVFHQEGERVLVLQSAGNLATTQSVISLLSARIRTQQEPNLMQVTSLYDAAMLIGKTLLEVIQRDSSNQQTCSNTNFNCNLLLGGQIAGETHRLFHIYPEGNFIEATRDTPYFQIGESKYGKPIIDRVLTIDTPLEQAMCCALISIDSTLRSNLSVGLPLDTLLYRSGSFSSAGQHRITDSDPYFNRIRKAWSEGLLHTFQTLPTWTPAEREDE

SEQ ID NO: 14165 - protein, 315 aa, Klebsiella pneumoniae
DAMNTFSLPKTQHLVVFQEVIRSGSIGAGAKALGLTQPAVSKIIGDMESYFGSELIVRRNTGVSLTEAGQVFLNWSEAITREMKNMVNEMNALTNSAVVDVSFGFPSLVGFTFMSEMVHQFKMTFPKARVSMYEAQLSAFLPAIRDGRLDFAIGTLSDEMKLQDLHVEPLFESEFVLVANRARIGNGTVRLASLQHEQWVLPETNMGYYSELLTTLQRSGIRRENIVNTDSVVTIYNLVLNADFLTVIPCDMTTPFGSSQFVTIPIKEALPVARYAAVWSKNYRLKTAAASLVEMAKYYSSGQGNHHWQPLQIIA

SEQ ID NO: 14166 - protein, 63 aa, Klebsiella pneumoniae
CSAKLGLAEIHLTTHSLNEILKNSDFQGARFTFSAKALRETFGQKGDNFFTAIQLRLIFHEIS

SEQ ID NO: 14167 - protein, 299 aa, Klebsiella pneumoniae
GKKKIMMRIALFLLTNLAVMVVFGLVLSLTGIQSSSMTGLLIMALLFGFGGSIVSLMMSKWMALKSVGGEVIEQPRNETERWLMNTVAQQAQQVGIAMPQVAIYHAPDINAFATGARRDASLVAVSTGLLQNMSRDEAEAVIAHEISHIANGDMVTMTLIQGVVNTFVIFISRVIAQIAAGFLGGNREDEGESSNGNPLIYFAVATVLELVFGILASIITMWFSRYREFHADAGSARLVGREKMIAALQRLKTSYEPQEASSMMAFCINGKAKSMSELFMTHPPLDKRIEALRSGEYLK

SEQ ID NO: 14168 - protein, 727 aa, Klebsiella pneumoniae
QIRFSRGGVQEYQTALVQDDLMNVAISRKRPGLLYALAVALPFTAQAEETVVVTATPPASASAPTEGYSASTSLGATKTDQPLITTAQSVSVVTRQQMADQGANTISQALEYTPGVYSSFGGGATRFDAISLRGYHGGDVDNLFLDGMRLMSDGGSHNVLQIDPWFIERVDVIRGPSSALYGQSVPGGVVNLTSKRPQFSQQGHIRLTGGTQNTKGAAFDYTDAINDQWAWRLIGMTRSSDTQYDHTREERYAISPSLLWQPDSDTSLLLRAYLQKDPSGGYHGSLPLDGTRYAHNGRKLSPSTNEGDPGDGYQRRQQIYSYEFDHQFTDVWSVYSAGSYTHTNVSLDQVYQVGWIDDSDMLARGYSGSRGSLDGWSTDNRLRADFNTGDLAHTLILGAEYHRFRNDLWTGAGGAAPLNPFSGYTAQTGHTVTYSDDNNRRYYQTGLYLQDEMVWNRWHVDVSARYDRIVSQQVSDTQGTSNRRSDDHISGRASLLYALDNGLSPYLSYSQAITPAMLPGADGKPLKPTTAEQVEAGLKFQPPGSSDLYSIAIYDLTQKDVATRDPNIATATYIPAGKVHSQGVELEAHHQITPQLSTIASYTWNRLRFQDTQDGTDNNTPQLTPDQMASFWARYQFPAGISVGAGVRYIGKQWADDANTARLPSVTLMDAMMRADLGVWSPTLKGAYVQVNANNIGDREYISGCYGTGNCYWGAERSVIATVGYDF

SEQ ID NO: 14169 - protein, 428 aa, Klebsiella pneumoniae
PCNLFRGGSLRLVFRDPHPNLQHVIVLFFSYRPHHPGELHLVAHHRRRAQQLLHHFPERLLMLAELLTAVETVDLRHIGEAGLSIKNEVAEKALIERHRRRLAEHFAQRRQVVLPTNNAQDIAFPQAGAAGGVQQDIVAKQRGNPRLRWHVQVAQRRADAPLIGPQLVDKLLPRVFRVNIQPDAGDGPADGRHHHFGFFRRPRQRSALQQKRHQHHEEGDIEEQAGVVQAGHHREHRENNGHRAAQANPADKHPFAQVKAAKRQQAGKHRQGPGNEYHPHRQQQRRDSDRQQVGGRHQQAQHQEHGDLRQPRQAVEVLQDAVPVADRPVAQQKAAEIDGEDTATVEGGGDGKNHDPAAQRQQRIEAGGQHDAVNHLQQQVAAAEADGDPEAELLNDMHGEHPAEAGLVLLDHFDQGDGQEDRHRVVTA

SEQ ID NO: 14170 - protein, 322 aa, Klebsiella pneumoniae
SRFDESRNIPYSARHNLLLFAVGIAKSVKNRTLGSILIVAGTTIGAGMLAMPLAAAGVGFTVTLGLLFTLWALMCYTALLLLEVYQHVPADMGLGSLAARYLGRYGQWVTGFCMLFLLYALTAAYISGAGELLASSLNQWLDWQLPPAAGVLIFTLLGGAVVCIGTALVDLFNRFLFSAKIVFLVIMLALLMPHIHQVNLLTLPVEQGLALSAIPVIFTSFGFHGSVPSIVSYLGGDIRKLRRVFIIGSFIPLVAYIFWQLATLGSIDAPAFTALLANNAGLNGLLEAIREVVASPHVELADSPVCRPCAGDVIPRRLARPV

SEQ ID NO: 14171 - protein, 63 aa, Klebsiella pneumoniae
RNIDIISKRHVVIRLHRQRNLVTGMPLRQYCHLLRQLIQQLESPPIFSPFFTGDTLQRFSFQT

SEQ ID NO: 14172 - protein, 464 aa, Klebsiella pneumoniae
RGIDVQREQRRRGQLIAHLVAFQIVVGVPSLFIIPQVFLDGLLAGVSQRIVLRSASAVPGCLAGAGEGFLQMEHQGIEIDRDNRGGANGGELLRIVHPAGAEIPAGGGGGAQVAIDLGCRTIRVAFGGFDVVKPGLGTRGVVIVPVAVEQRAVRHPHRPFVGAAGSQRVRSGHPVAILFLQLRLVGFQHLVAIVRRQQAHHKGEEGGLRTAEIIGAVAVGDMAPGVNFCGEVGDHILDFIPVTAFGKTQHREIAVPVIDFAETSSGHHVGLRQRQQRVPFFHLDGAAGQDRPQAIDMLTQSLPFGRHIGVVLFRQREVQFDEVAQVEAGLVFLHPVIGKDHQRIAVRDSVGEGFLIGKQLRALDIIEQRAQQNIRRGGRRGFAVFRLSVQAHQGDQSAADRQAQGTGQNSGTTCISTRHGEFSLSLSTAGHDVWPSKNLRRISAAARVRGNILRENRGFTCQVF

SEQ ID NO: 14173 - protein, 337 aa, Klebsiella pneumoniae
GMIEADRLVSADSSGFEEAADRAIRPKLLAEYVGQPQVRSQMEIFIQAAKLRGDALDHLLIFGPPGLGKTTLANIVANEMGVNLRTTSGPVLEKAGDLAAMLTNLEPHDVLFIDEIHRLSPVVEEVLYPAMEDYQLDIMIGEGPAARSIKIDLPPFTLIGATTRAGSLTSPLRDRFGIVQRLEFYQIPDLQHIVSRSARHMGLEMSDEGALEVARRSRGTPRIANRLLRRVRDFAEVRHDGTISADIAAQALDMLNVDAEGFDYMDRKLLLAVIDKFFGGPVGLDNLAAAIGEERETIEDVLEPYLIQQGFLQRTPRGRMATVRAWNHFGITPPEMP

SEQ ID NO: 14174 - protein, 336 aa, Klebsiella pneumoniae
SITESGGAMSLQNLTRFPRLELIGAPTPLEYLPRLSDHLGREIFIKRDDTTPLAMGGNKLRKLEFLAADALREGADTLITAGAIQSNHVRQTAAVAAKLGLHCVALLENPIGTRAENYLSNGNRLLLDLFNTQVEMCDALTDPAAQLDELATRIEAQGYRPYVIPVGGSNALGALGYVESALEISQQCEDAVAISSVVVASGSAGTHAGLAVGLEQLMPQAELIGVTVSRSVADQLPKVEALQQAVANSLELQAKAEIILWDDYFAPGYGTPNEDGMAAVKLLAQLEGILLDPVYTGKAMAGLIDGITQKRFKDEGPILFVHTGGAPALFAYHPHL

SEQ ID NO: 14175 - protein, 320 aa, Klebsiella pneumoniae
VATEEGKMTMRRVKLLCTALMLLASHGALAVSYPLPPEGSRLVGSAFTIAVPENNTQPLESFAAQYGQGLSNMLEANPGVDVYLPRSGSTLTIPQQLILPDTVREGIVINVAEMRLYYYPPLGNSVEVLPIGIGQAGRETPRNWVTAVERKQEGPTWVPTANTRREYAKEGKTLPALVPPGPDNPMGLYAIYIGRLYAIHGTNANFGIGLRVSQGCIRLRNDDIKFLFDNVPVGTRVQLIDQPVKYSVEPDGSHWLEVHEPLSRNRAEFESDRKVPLPMTSALRDFTQGPGVSPAQVEQTLQRRSGMPVNISATAAQGSL

SEQ ID NO: 14176 - protein, 67 aa, Klebsiella pneumoniae
RRNEEKMMNINIPALINFDPAGIKKSTCMYISDLPGIVLYDTIPFTEYSAELLSTYSVKESISCFHP

SEQ ID NO: 14177 - protein, 398 aa, Klebsiella pneumoniae
VTNESPDAGYAGVFYGRKLREYALNYQMITTDDGLRAVCEAASAASAVALDTEFVRTRTYYPQLGLLQLFDGQQVSLIDPLTINDWAPMRDLLLNQDVTKYLHAGSEDLEVFLNAFNLMPQPLIDTQILAAFCGRPMSWGFASMVEEYSGVALDKSESRTDWLARPLTERQCEYAAADVWYLLPIASQLMAETDRAGWLPAALDECRVMQQRRQEVVDPAEAWRDIGNAWQLRTRQLGCLQLLAEWRLRKARERDLAVNFVVREEHLWSVARYMPTSLGELDSLGLSGSEIRFHGKTLISLVEKAQALPESVLPAPLQNLIDMPGYRKAFKDIKALVQEVSTEKGVSAELLASRRQINQLLNWHWQLKTQAGEPELISGWRGELMAERLKTLLNDYPR

SEQ ID NO: 14178 - protein, 73 aa, Klebsiella pneumoniae
IVCEPEHEARMFALVLFICYLDGGCEDIVVDVYREETQCLVAMEDQRIRHGGCYPIEDFIDGFWQPASEYSDF

SEQ ID NO: 14179 - protein, 566 aa, Klebsiella pneumoniae
EMRDNARRLLTILTVILALWLVLGFWPLSIGNQVIFSLCILLAGGAALWRQRRRAVSRQRSEIVLPPEDFQGAVVLVCGDTDGLFPGRSAHGETRHGWYLRGDSAEQLPRLAQYLAAARPALVSQVSVLLAVVPEHHPSGEHLAQSLRDWRRSIVQCRTWLNGLPPVWSVFWVTPPGGQAVESRWFTVTPERPGLQVQQKGQAPQAVAGWQREGSPASRLHQTLWLESILTLAENALFRPFRARQAELPPLNLCAAGICLTPVAAVANNLWQQQIAGITTLSPGNDAAPGPHPLPDLLLSSLPHRHGVSRRMRDAGLAAGVGFLFLALAMLASFINNQRLVRSVGDHLAVYHRLSGTPPTPKLQAQQRLRADSRLLDDWLRRGEPLRYRLGLYQGGRLIPFVEAAINDWAPPPPPRPVIKQVVQGPQTIRLDSMALFDTGKSALKPGSTKLLVNSLLGIKAKPGWLIVVAGHTDSIGNDRSNQQLSLKRAEAVRDWMRDTGDVPESCFAVQGYGASRPVASNETPEGRAQNRRVEISLVPQKDACLTPGTANTSGAETNGLKSETE

SEQ ID NO: 14180 - protein, 444 aa, Klebsiella pneumoniae
RGSEYVQQIARAVTQAFNNLPRPHRVMLGSLSVLTLAVAVWRPYIYHPESAPIVRTIELEKSEIRSLLPEASEPIDQAPQEEEAIPQDELDEKADSDAGGHEYVVSTGDTLSSILNQYGIDMGDIAQLSSADKELRNLKIGQQLSWTLTADGDLQSLTWEMSRRETRTYTRVDNGFKMSSELQKGDWVNSVLKGTVGASFVSSARDAGLTSTEINAVIKAMQWQMDFRKLKKGDEFSVLMSREMLDGKREQSQLLGVRLRSDGKDYYAIRAEDGKFYDRNGTGLAKGFMRFPTARQFRVSSNFNPRRLNPVTGRVAPHRGVDFAMPQGTPVLAVGDGEVVVAKRSGAAGYYVAIRHGRTYTTRYMHLRKLLVKPGQKVKRGDRIALSGNTGRSTGPHLHYEVWINQQAVNPLTAKLPRTEGLSGSDRTDYLAQVKEVVPQLRFD

SEQ ID NO: 14181 - protein, 304 aa, Klebsiella pneumoniae
CNGEGDKMRKLIVVASVAASLLLGCDQKSTDKRETLSETLVAKSLSNMVPVKGGEFLMGDFGPLVGEKLPFSINQDDKVLHKVVLSDFSISKFKVTNDDYNKYLQITGIKKPPINILVKEYPSLQKGDYSVGVTWQQAKDYCQWLGKESDRNIDLPTEAQWEYAARSRGQYIPFATNNGEFLPGKNIPSQDELSEYTDGAGIPIYPVGKYPPNPLGLYDMGLSGSEWTNDWYASDYYSHSPVNDPQGPVKGTEKVLRGNVGGDRQYALTVFRQSDLPVPKINKDDDYEKYGVGPQYVFRCVINK

SEQ ID NO: 14182 - protein, 60 aa, Klebsiella pneumoniae
SCFELQPARKTTKISNHLNFTHLSLSTQTPSCYRTTAAVRLPPADNLKDDGCGLKLATWR

SEQ ID NO: 14183 - protein, 318 aa, Klebsiella pneumoniae
RILEGDIDEKRRKIILAGSSLLTLLDDIATLLDDISVMGKVAAKKTAGVLGDDLSLNAQQVTGVRANRELPVVWGVAKGSFVNKVILVPLALLISAFIPWAITPLLMLGGAFLCFEGVEKVLHSLEARKHKEDPERRQQRLAALAERDPLAFERDKVKGAIRTDFILSAEIVAITLGIVAEAPLLNQILILSGIAILVTIGVYGLVGVIVKLDDMGYWLAEKRSALAQWLGKGLLAVAPRLMKVLSIVGTLAMFLVGGGIVVHGIAPLHHAIEHWSAGLGGVMASTLPVVANLVLGFIIGAVVLAGVKAVSSLRGAGK

SEQ ID NO: 14184 - protein, 334 aa, Klebsiella pneumoniae
PPSDEEYSVMKALVLDQIDNRTVATVKDIDLPALAEGDVRVAIDWSSLNYKDALAITGKGKIIRQFPMVPGIDFAGQVKESRDPRFVPGQAVILTGWGVGENHWGGLATEACVKGDWLVALPETLSARQAMIIGTAGFTAMLCVDALVSAGVTPDSGDILVTGASGGVGSTAVVLLKALGYRVMAVSGRESTHDYLRQLGADTILPRSDFAETRPLEKQLWAGAVDTVGGPVLAKVLAQTQYRGCVAACGLAGGFDLPTTVMPFILRNVRLQGVDSVMVPTAERDAVWQRLAQLLPESYYQQAATEITLEQAPAYAADFLSNNIHGRTLVNIGQ

SEQ ID NO: 14185 - protein, 227 aa, Klebsiella pneumoniae
YRNDSMQESIQLVIDSAPFLLKGAVFTLQLSIGGMFFGLVLGFILALMRMSPVWPVKWLARMYISIFRGTPLIAQLFMIYYGLPQFGIELDPIPAAMIGLSLNTAAYAAETLRAAIASIDKGQWEAAASIGMTPWQTMRRAILPQAARVALPPLSNSFISLVKDTSLAATIQVPELFRQAQLITSRTLEVFTMYLAASLIYWVMATVLSSLQNYFENQLNRQERDPK

SEQ ID NO: 14186 - protein, 175 aa, Klebsiella pneumoniae
SRRLRRPMALPTFLHRWWCQLRLKYCPECGFSRFSLSLQQITINYAAQSRGYYGFRQIGITSCVMKCLHNKRAKACAGARRGLTVWPKLAVFAGGVMSSIHGHEVLQMMLASGESWTVASLEAAIRRRFGEEARFHTCSAENLSAAQLVAFLEKKGKFIAREEGFTTAENKICRH

SEQ ID NO: 14187 - protein, 287 aa, Klebsiella pneumoniae
QVSEMVDMTKNTTEKKLTQSDIRGVFIRSNLFQGSWNFERMQALGFCFSMVPAIRRLYPENNDARKQAIKRHLEFFNTHPYVAAPVLGVTLAMEEQRANGAEIDDGAINGIKVGLMGPLAGVGDPIFWGTVRPVFAALGAGIAMSGSLLGPLLFFILFNAVRLLTRYYGVAYGYRKGVDIVKDMGGGFLQKLTEGASILGLFVMGALVNKWTHVNIPMVVSKITGSDGQVHVTTVQTILDQLMPGLVPLLLTFACMWLLRKKVNPLWIIVGFFVIGIAGYAVGLLGL

SEQ ID NO: 14188 - protein, 108 aa, Klebsiella pneumoniae
LALFAPLTTLKNNGHNWSYHNSAEKWGEAMSKTNVRIGAFEIDDAELHGEHQGERTLSIPCKSDPDLCMQLDAWDADTSVPAILNGEHSVLYRKHYDRQSDAWVMRLA

SEQ ID NO: 14189 - protein, 136 aa, Klebsiella pneumoniae
HPGLTQFAVYQPPKCGDIPKTKRHVIVTHILRQVTTGLIPSKTMFCVIYRSTKREQTYLYVEKKDDFSRVPDELMRSFGTPQMAMLLPLDGRKKLVNADLEKVKQALSEQGYYLQLPPPSENLLKKHLAEQGKQSD

SEQ ID NO: 14190 - protein, 129 aa, Klebsiella pneumoniae
RWPDSRHAYAAPENPATPRRGPPSPPPAAASPRSRGPGTGSPAPGRRRRWRKTPHSPDRADPRGPPQYSTPGQAERRSAQEWPRSADILWRETERQWPAPPAAVLSSAAASGSPAAGRTPRHPPPQSGQ

SEQ ID NO: 14191 - protein, 220 aa, Klebsiella pneumoniae
IWREKILMKNWKTTAEAILTSGPVVPVIVVKKLEHAVPMAKALVAGGVRVLEVTLRTECALEAIRAIAKEVPDAIVGAGTVTNVEQLKAVTEAGAQFAISPGLTESLLKAATEDGTIPLIPGISTVSELMLGMQYGLKEFKFFPAEANGGVKALQAIAGPFGHIRFCPTGGISPANYRDYLALNSVLCIGGSWLVPADALEAGDYDRITTLAREAVEGAK

SEQ ID NO: 14192 - protein, 245 aa, Klebsiella pneumoniae
GRGDAPMSQPLLAFNEVDVFYGPIQALKQVSLTVNEGETVALIGANGAGKSTLLMSVFGQPRIAGGEIFYRGEAISRKSTHFIASNGIAQAPEGRRIFPDMTVEENLLMGTIAIGNRYQAEDKARMYQLFPRLEERRGQRAMTLSGGEQQMLAIARALMSRPRLLLLDEPSLGLAPLVVKQIFQILRELTAQGMTLFLVEQNARHALNLSDRAYVMVNGQIRLSGSGQTLLNDPEVRKAYLGISG

SEQ ID NO: 14193 - protein, 236 aa, Klebsiella pneumoniae
YVGDKVSVALSLILEIIPLINVLLVDDHELVRAGIRRILEDIKGIKVAGEACCGEDAVKWCRANSADVVLMDMNMPGIGGLEATRKIARSVAGTKVIMLTVHTENPLPAKVMQAGAASYLSKGAAPQEVVNAIRCVASGQRYIASDIAQQMALSQIEPEKTESPFASLSERELQIMLMITKGQKVNEISEQLNLSPKTVNSYRYRMFSKLNIHGDVELTHLAIRHGLCNAESLASQ

SEQ ID NO: 14194 - protein, 197 aa, Klebsiella pneumoniae
PAVDHRWLLRHRYRRLRGRPAGSVISRLYAGGLPPAFFYQEKRKAMTFTDLVIILFILALLAYAIYDQFIMPRRNGPVLLAIPLLRRSRVDGMIFVGLTAILIYNNITQHGTAITTWLLSALALMGLYLFWIRTPKIIFKPRGFFFANVWIEYQRIKEMNLSEDGVLVMQLEQRRLLIRVRNIDDLEKIYKLLITTQ

SEQ ID NO: 14195 - protein, 486 aa, Klebsiella pneumoniae
VQPEGIAMIKITLPDGHYYDEMLTAQGEQRPHYNAWWQWFRNTDQFSIRQKKAQAELLFHRIGITFNVYGEDEGTERLIPFDSVPRIIPAGEWQRIDRGIRQRVKALNAFLYDIYHEQNILRAGLIPAEQVLANEQYQPCMQGINLPNNTYAHITGVDMVRNNDGQYYVLEDNLRTPSGVSYMLENRKMMMRLYPEMFEQHHIAPVERYPSYLLQTLRESSLVDDPCVVVMTPGRFNSAYFEHSFLAQQMGVELVESADLFIKNGAVYMRTTEGPRRVDVIYRRIDDAWLDPLAFRADSMLGVPGLLSVYRAGGVVLANAIGTGVADDKSIYPYVPEMIRFYLGEQPILSNIPTWQCRKAEDLRYVLSNLELMVVKEVHGAGGYGMLVGPRSTKEEREAFRQRLLANPANYIAQDTLALSTCPTFVDEGLSPRHIDLRPYVLSGQEMRLVPGGLTRVALTEGSLVVNSSQGGGTKDTWVMEDDASC

SEQ ID NO: 14196 - protein, 193 aa, Klebsiella pneumoniae
TMADRALNLDDFLSRFQLLRPQPSRHALNQRQAAVLVPIVRRPQPGLLLTQRSPLLRKHAGQVAFPGGAVDNTDATLIAAALREAQEEVAIPPEAVEVIGVLPPVDSVTGFQVTPVVGIIPPDLHYHASQDEVSAVFEMPLAEALRLGRYHPLDIHRRGNDHRVWLSWYQHYFVWGMTAGIIRELALQIGARP

SEQ ID NO: 14197 - protein, 93 aa, Klebsiella pneumoniae
SHEDIIMKKRFSDEQIISILREAESGVFARELCRKHAISDAAYYTWRKKFDGMEMPEVKRLKSFEEENAHLKELLAEVMMDKEALQVALNRKF

SEQ ID NO: 14198 - protein, 82 aa, Klebsiella pneumoniae
LNEDTMRKPVYYAYVAQESHPDSQGEKNTWWTKVGVAFPHHGKSGLNIVLTPGIAVSGKLVLLEPREENNPPQNTGPIETVS

SEQ ID NO: 14199 - protein, 473 aa, Klebsiella pneumoniae
WKRDRWLSRVLMHNCSHIMDVIRRCGRRKWPRACGATTGFPRLESGCMSDVQSNVKPLTLTTGRVIFAIAGVYVTQSLVSALSMQSLPALVRAAGGSLALAGATTLFMLPWALKFIWAPWIERWRLPPGSQERRSRMLILRGQVALAAILMIAAAIGWFGREGGFPDTQIVALFVLFMVAGTVASTIDIASDGFCVDQLTRAGYGWGNSVQVGGSYLGMMCGGGVFLMLSAASGWPVAMLMMAMLIMALSFPLWRITEPTRTAPIPHVPALGYALRRKQARLGLLLVLMLNSGMRFVLPLLAPLLLDHGLSMSALGALFSGGNIAAGIAGTLAGGLLMKYTSPGRALLTAYGVQGIALLAVLMTFMMAPGHLLLPILQCLVIVQSISLACALVCLYATLMSLSSPLQAGVDFTLFQCTDAAIAILAGVIGGVVAQHFGYAACFLFAGVFTLLAAWVAYIRLHSARELMTSAID

SEQ ID NO: 14200 - protein, 193 aa, Klebsiella pneumoniae
RYGDTMLELNAKNTALVVIDLQEGILPFAGGPHRADEVVARAARLADKCRQQGSPVIMVRVGWSADFAEALKQPVDAQAGAHTLPENWWTYPATLGKQESDIEVTKRQWGAFYGTDLELQLRRRGIDTIILCGISTNIGVESTARNAWELGFNLVIAEDACSAASAEQHQGSMTHIFPRIGRVRSTEEILTAL

SEQ ID NO: 14201 - protein, 74 aa, Klebsiella pneumoniae
RRGESVKPALSRCSMPTARCSMRASSTAPVRMMATAGGARIRCRRAFSALSTPGKSSGNGSASCCESPRRMRQC

SEQ ID NO: 14202 - protein, 344 aa, Klebsiella pneumoniae
VAGFYYLLPGTTDFNNSRYVKSIGPEERVNFQQLKIIREAARQDYNLTEVANMLYTSQSGVSRHIRELEEELGIEIFIRRGKRLLGMTEPGKALLSIAERILNEASNVRRLADLFTNDASGVLTIATTHTQARYSLPPVIKAFRELFSDVRVELVQGTPQEIEALLHNGGADIGIASERLSNDPTLAAFPWFRWHHSLLVPKDHPLTQVSPLTLEAIARWPLITYRQGITGRSRIDEAFNRKGLMPDIVLSAQDSDVIKTYVELGLGVGLVAEQSGDAREADTFTRLDTRHLFDANTVWLGLKRGQLQRNYVWRFIELCNAGLSLDEIKRQAMEPEEAAIDYQI

SEQ ID NO: 14203 - protein, 401 aa, Klebsiella pneumoniae
SQPLANHDGSPPRSGLCATHYALALRNLNATGEHVMMPSASPKQRVLIVGAKFGEMYLNAFMQPPEGLELVGLLAQGSARSRELAHAFGIPLYTSPEQITRMPDIACIVVRSTVAGGTGTQLARHFLTRGVHVIQEHPLHPDDISSLQTLAQEQGCCYWVNTFYPHTRAGRTWLRDAQQLRRCLAKTPPVVHATTSRQLLNSTLDLLLLALGVDAAAVECDVVGSFSDFHCLRLFWPEGEACLLLQRYLDPDDPDMHSLIMHRLLLGWPEGHLSLEASYGPVIWSSSLFVADHQENAHSLYRRPEILRDLLGLTRSAAPLSWRDCCETVGPEGVSWLLHQLRSHLAGEHPPAACQSVHQIALSRLWQQILRKTGNAEIRRLTPPHHDRLAGFYNDDDKEAL

SEQ ID NO: 14204 - protein, 93 aa, Klebsiella pneumoniae
TRQLLTLIIYEVFMLSKKIILISTITLCFSIVGCKEEAKTTKWYRDHPDELKLAYEKCQKSGDASDNCKNANEAHYQIKQLNAPTPDLNNLEE

SEQ ID NO: 14205 - protein, 580 aa, Klebsiella pneumoniae
IPSCLMPKILLLIGGRWMTANMPSTISSANFCACRKPCKLTRGKRWRSIMPVFSSNLWLSSARSCRGSRWRWMKRFCAALHRRRQPTGDLWYSLPKSSALVEDMPQKLSKEHRSLSLAEQAGEHAEALLRQLMTIYDVKTLVAELVSVGEQHWSAAILKRVVALGRVAERLRPQEVAHLATLLPSPPAHHPHYGFRFIDLFAGIGGIRSGFEAIGGQCVFTSEWNKHAVRTYKANWYCDPQQHRFNEDIRDITLSQRSDVSDEEAARHIRESIPQHDVLLAGFPCQPFSLAGVSKKNAMGRAHGFACETQGTLFFDVVRIIAARQPAIFVLENVKNLKSHDQGRTFRIIMQTLDELGYEVADAGHTGPDDPKVIDGRHFLPQHRERIVLVGFRRDLQLHAGFTLRDIAAQYPAVRPTFGELLEPTVDAKFILTPVLWKYLYRYARKHQARGNGFGYGLVDPANPHSVARTLSARYYKDGAEILVDRGWDRPLGEKHFDDPLNQQRRPRRLTPRECARLMGFESPQGARFRIPVSDTQAYRQFGNSVVVPVFAAVAKLLAPRIAQAVARREADDNDGGCSR

SEQ ID NO: 14206 - protein, 329 aa, Klebsiella pneumoniae
LANCHMTAVDRERNPAAVCLAAGGAMTAFFLQQLINGLTLGAVYGLIAIGYTMVYGIIGMINFAHGEVYMVSAYLCAIGLALLSFFGIHSFPLLIFATLVFTIVVTGVYGWAIERIAYRPLRNSTRLAPLISAIGMSLILQNYVQLSQGPNQQGIPTLLSGALRMTVGDGVVQITWTKVFILVAALVGMLILTWIIQYTRLGRICRATQQDRRMAAILGINTDRVISLVFVIGAAMAGLAGVLVTMNYGTFDFYIGFIIGIKAFTAAVLGGIGSLPGAMLGGLLLGVAEAQFAGLVNSDYKDVFSFALLVAILIFRPQGLLGRPLVAKV

SEQ ID NO: 14207 - protein, 125 aa, Klebsiella pneumoniae
NRRCAFAHSGRPEPAPYFHLLQPPASPAPAPPLAPADLSAATDGPAASGGGRAPPSRTRCRRPPAPAAARCPAAANAPAGRYRAAYAPLQTGTGTAGWDRYRPPDVRRRRSSATCDSRCRSLRRG

SEQ ID NO: 14208 - protein, 492 aa, Klebsiella pneumoniae
GRGCNIWRMTRKPKGGMTMSRLVVVSNRIALPDDKKSSAGGLAVGILGALRAAGGLWFGWSGEIGDDQQPLKQVSRGNISWASFNLNERDHDEYYNQFSNAVLWPAFHYRLDLVSFQREAWEGYLRVNAMLADKLLPLIEPDDTLWIHDYHLLPFASELRKRGVNNRIGFFLHIPFPTPEIFNALPPHAELLEQLCDYDLLGFQTESDRTAFLDSIAMQTRLSDLGDKRYQAWGKAFSTEVYPIGIDPDEITRNAKGPLPPKLAQLKNELKNVKNIFSVERLDYSKGLPERFLAYETLLEKYPQHHGKIRYTQIAPTSRGDVQAYQDIRHQLETAAGRINGQFGQLGWTPLYYLNQHFDRKLLMKVFRYSDVGLVTPLRDGMNLVAKEYVAAQDPDNPGVLVLSQFAGAAQELTSALIVNPYDRDEVAAALDRALSMPLAERIARHSAMLDVIRENDIHNWQARFVEDLQHISPRSEESRLRGKIATFPKLA

SEQ ID NO: 14209 - protein, 237 aa, Klebsiella pneumoniae
RNTWRNRGNNPINPRGKIMYQHHNWQGALLDYPVSKVVCVGSNYAKHIKEMGSATPEEPVLFIKPETALCDLRQPLVLPEGLGSVHHEVELAVLIGSTLRQATEEHVLKGIAGYGVALDLTLRDLQAKMKKAGQPWEKAKGFDNACPISGFIPAAEFHGDPQNTSLSLKINGEVRQQGTTADMIHRIVPLIAYMSRFFTLKAGDVILTGTPEGVGPLHSGDELEVGFNGLALTTRVL

SEQ ID NO: 14210 - protein, 269 aa, Klebsiella pneumoniae
DFAWRESQRDVRQHAALAKGHRDIFQRYKVCHSNLGVAQASECYNITSHSLISMTRRIMLHKNTLLCAGLGAVFLFAQVPLASAAVVTSMKPLGFIAAAIADGVTETQVLLPDGASEHDYSLRPSDVKRLQNADLVVWIGPEMEAFMDKSTQSIAANKKVTIAELDGVKPLLITGADDDDDHHGHDHGAAEKGDGDHHHGIYNMHLWLSPEIARLSAVAIHDKLLELMPQSRAKLDSNLQQFETALAATDKHVSNELAPLEREGLFRFS

SEQ ID NO: 14211 - protein, 148 aa, Klebsiella pneumoniae
TACWRRSAKWWRHRMWSWPIHLFADLALATSFLGVSLGLFDYLADMFQRKNSVGGRLQSGIITFLPPLAFALFYPRGFVMALGYAGVALAVLALIMPALLVMKSRREHPQATWRVAGGAPTLWLVLLCGIGIVAIQFSIAAGLLPAVG

SEQ ID NO: 14212 - protein, 119 aa, Klebsiella pneumoniae
AMSWHRWKGKGYFVFHDAYGYFEKHYGLTSLGHFTVNPEIQPGAQRLHEIRTQLVEQKATCVFAEPQFRPAVIEAVARGTSVRMGTLDPLGTGITLGKTSYPQFLTQLANQYSSCLKGD

SEQ ID NO: 14213 - protein, 69 aa, Klebsiella pneumoniae
TQQCRFHFSRGYFFSGAVDLLFYASLNVQVPYLIQPDIVACAVKPLRGKGLRVVGRGAVIARNGIRAAR

SEQ ID NO: 14214 - protein, 74 aa, Klebsiella pneumoniae
SRSRDGADRSASDGYRWRSAESALIKPLSLCQGERVCAAPPGLLIHYVYFFSPIIPFKNKKVLTRSHSLITVTP

SEQ ID NO: 14215 - protein, 157 aa, Klebsiella pneumoniae
YAPRRACPPFAAYYWPEYESHCGCCFSPSQGRHAASHAAHAQYTAGRDRLRGKQSPPPCPGSAGSESRTRRRRRVWRDAPACFPDPALYPLCQRQISPGTGRTHLARHRYHSPSRWSPAPSWCQSPSGAAAAADASTMFRCRAPPAGTPAAPPGGWR

SEQ ID NO: 14216 - protein, 64 aa, Klebsiella pneumoniae
TPDRDRFHLARCILLTVFFLSQCVMQFQTTVSEGAVHDERFSVTSIMASSASGESMFSTRYFCH

SEQ ID NO: 14217 - protein, 409 aa, Klebsiella pneumoniae
KQRRRASAERDNHLPAAAGVRPVLSPRFRHGPRLRRGGISRAGADNAGPAGHEESPRASAGYLAGRRRRTDAMAGSAVRDRHRGYSVQHRCRVVARGGIKKGPAGPLFISLSNTAYTFYRCRMGRDRCVRLSLHFLLAAGPPPAADSLSVLVKRQRRRRDTLDAGDKFIRRQIIQRAKLFFAAVERDSVQLRLEFSGQRRPVAQRHAAQIAKAPLLNYGQLLTFRFAGAEQRFELIGIRLQPFGDIAHMLQRQIDKAIALAIVGPARDIIRPAPNRQQPLSGFDVGRRREDRRQQAIQFRDIQNGAFGGVFRQSVIQPFQFVFVQRSGIHSQARMVKIGPTVAELPTESHPAIPIAPVSTIRDQARPRSADATSRQASSPNESKGRGSESGSQSPSIAAALAITRRLPP

SEQ ID NO: 14218 - protein, 96 aa, Klebsiella pneumoniae
CQSRARHLALTGFISRVEWMMERNLAKISQDEMDKVNVDLAAAGVAFKERYNMPVVADLVEREQPAHLRDWFRERLIAHRLASVSLSRLPWEPKQK

SEQ ID NO: 14219 - protein, 311 aa, Klebsiella pneumoniae
RIMLSRTASELFWMARYLERAESYARVLDVTWKLSMIPRHSQQSRDLALPLNLSMTHELFQARHARFTMSNLLNFFALDGNNPCSIYSCVEMAWNNAHAVRGSLSAEVWESINATRIELRSLRQQGLGELGSDGFFEWVKERVHLFRGAVIGTLLRNDALSFIGIGTLIERAFATTQLLLIKDQQLTNDPDPVREYYRLDTLLNAVSAREAYNSLYRQPVSRETVMELLILRNDIPRSLRASIADLVGELEKIANDRSYQPLRLAHQLNVDLRFSTRDDLAQADLQTTLNGLLARINALSDSIRQTYLEAL

SEQ ID NO: 14220 - protein, 279 aa, Klebsiella pneumoniae
TPIRALASRREENMAERMTFPMYAIHRQQTQALWQAVQSLLDERGVMVAGDPPAADPGDLLAHWRQPTLLLSQTCGYPLVTQLPEVQTVGCFHYAAPGCEGRRYRSLLVVREADSHRMLGDFFGRRAVCNAEHSQSGYNVLRKMVAPLSREGRFFSAVMFSGSHRQSLRELQQENADIAAIDCVTYALLQRHQPQALAGLVAIGWSPAAPGLPLITAGATPAATLNSLREALQQLVSDDRYRSLCDALLICGYSDMSREAYAPLLAWRDEAAALGVSQL

SEQ ID NO: 14221 - protein, 285 aa, Klebsiella pneumoniae
RAVRQHQTNLPGGLMKLVIDHLTRYGYDEEVKFSTQYLRLTPRSTARQTITAWTLTLPDGAAVTTTDGWGNVLHVLTLDNPHKEITIRASGIVDIADEGEETRDEEAELLSPLVFLRCTPLTRADTAIREFAQRLYRPDAAEESLNQLMADLLLRMPYFPGATQVQDSAADAFARAKGVCQDHTHVFLACCRALEIPARYVSGYVYSDNAQHVAMHAWAEVWLDGRWLSFDITNNTRRLNQHLRLATGLDYLDACPVRGTRLGGGGEIMLTNAEVREHSQQAQQQ

SEQ ID NO: 14222 - protein, 468 aa, Klebsiella pneumoniae
HRYRTRGNPVRSIIVISLFDMFKVGIGPSSSHTVGPMKAGKQFVDDLVEKGLLNAVTRVAVDVYGSLSLTGKGHHTDIAIIMGLAGNQPDTVDIDAIPAFIRDVEARGRLLLANGQHEVDFPADDGMRFRSDNLPLHENGMTIHAWAGEKEIYCKTYYSIGGGFIVDEEHFGKENANELQVPYPFKSAQEMLAYCKETGLSLSGMVMQNELALHSKKEIEDYFANVWQTMRACIDRGMNTEGVLPGPLRVPRRASALRRLLVASDKLSSDPMNVVDWVNMFALAVNEENAAGGRVVTAPTNGACGIVPAVLAYYDHFIESVSPEIYIRYFMACGAIGALYKMNASISGAEVGCQGEVGVACSMAAAGLAELLGASPEQVCVAAEIGMEHNLGLTCDPVAGQVQVPCIERNAIASVKAINAARMAMRRTSEPRVSLDKVIETMYETGKDMNAKYRETSRGGLAIKVQCD

SEQ ID NO: 14223 - protein, 127 aa, Klebsiella pneumoniae
AINRKRRRAETHAPACRRNKTCGARPQRSPADQRRRPASSRQASQVTEVQSLAAVSPTQYNSPLKVVAVIMVVAVYPQLFRAARAEHGDKLRVHGDHLRCARAADMLVQAQNFVGFGHHQTQIVGYH

SEQ ID NO: 14224 - protein, 513 aa, Klebsiella pneumoniae
RLNREPSHMLQNNPDLQSAIKRLWDKFWSSGISNPLTAIEQITYLLFMKRLDELDHKRQDEGETSGEKYISKFAGTWIPPEERNRPVAEQHPIDKRTLRWSEFKKLQPEEMLQHVRDKVFPFLKDLNGAESNFTHHMKNAVFIIPKSALLVEAVKAIDEIFEMMKRDSQEKGQAFQDIQGDVYEFLLSEIATAGKNGQFRTPRHIIKLMADLVQPQLGQRIADPACGTGGFLLGAYQYILTQLSLSQNLKRDNSKGSTHDEDGFFRTSVTAALTKKARILLQESLYGYDIDATMVRLGLMNLMMHGIDEPHIDYQDTLSKSYSEETKYDIVLANPPFTGSIDRGDINENLKLSTTKTELLFVENIYRLLKKGGTACVIVPQGVLFGSGKAFKELRQTLVERCDLKAVITLPSGVFKPYAGVSTAILLFSKVFGPGDKISKPATDYVWFYEMSSDGYSLDDKRNKLEGYGDLQDIIQKYHSRDEASDTDRTAKCFMVPRMDIEAENYDLSLSRY

SEQ ID NO: 14225 - protein, 479 aa, Klebsiella pneumoniae
LAGRSGRRAWRLLFFVARRTSDHRAHQIHPVIIRFHYGKMQRRKRHDVANARDMTIGGDHQPGNGGNILIVIDQWIQPQRLLQRMQVGRPLNKPAIAIDDNLWRLISVREFTGDGFKDVQRRDQPLHHAKFISYDDEAAARPTQDPEQIDRVQRFRNDNCRGGRSQRRDVFPRLQGHQHLFRPHDTNDFIQLSAADREEAVRRRQQLTTNFIFTLFSVDPADFSARGHDAAQGALGQGQHAVNHVALFFRKGALRNGHRGWTVCVMADGGLFAAAHQAQDGIRGPSAQRQRRLVANKVTARHLVKELDNDRETDRRVQIPFWNMEAKPFRHQAQANHQQEAQTEHDHRRVLVDKARQRLGGQQHQDHRDHHRRHHHRQMVNHPDRRDHGVQGEDGIQHHYLQYYYPETGIAFTVTGIVLAVFQPFMQLGCRLKQQEDPAEQHDEIAPGKGEIGDGNQWFRQRYHPGDDRQQPQAHNQRQ

SEQ ID NO: 14226 - protein, 84 aa, Klebsiella pneumoniae
GWLRHGFDGARILWWIIFLPGLKQDQFAGNGNTGRQDNIQTGFTVVGKGDSDLCPPGIFLTLRVRMTFLGNIRVINRLSHSVLV

SEQ ID NO: 14227 - protein, 551 aa, Klebsiella pneumoniae
VRLRNNIRESVMKHLFRHWRTSGAVIGSLLKKGSIAVLALLVVFLAGRIYESQRGPALHRWHTWSGNEMSAEEIDQATFAQYLAREKTIFADLQREVTEALPEEDKTPVNRFYRHSRVWPGQFQQDWNRSFVLMPLGKPRGSVVLLHGLTDSPYSVRYLAQLWQQRGYVAVVPRLPGHGTAPGALTAVDWETWLAATRLAVREATRLAGADVPLHLVGYSNGGALALKYALDSLEDSHLRQPQQIILLSPMIGVTAFARFAGLAGLPSVFPAFARAAWLNVAPEFNPFKYNSFPVKAARQSWLLSQALQQQIIRAARQGELKALPPILTFQSVMDSTVSTRAVVESLYRYLPDNGSELVVFDINQAADLRVLFRPALYAAVNTLLAPAPRAYTTTVVTNATAHTLQTVARTTLAQEREEHRYPLHLAWPADMYSLSHVAVPFPLSDSLYGREPDEKNRYGISLGTISLRGETGTLSVGLETLMRVTSNPFFPWMMTRVDERIACGEQAAVAACLKAQARAEALKQDQVQNGTQQDADDRRGSHEAEQADKP

SEQ ID NO: 14228 - protein, 260 aa, Klebsiella pneumoniae
RTIRRFRFFGFNVMSHRDTLFSAPIASLGDWTFDERVAEVFPDMIQRSVPGYSNIISMIGMLAERFVQPNTQVYDLGCSLGAATLSVRRNISHPGCRIIAIDNSPAMVERCRRHIDAYKAPTPVEVIEGDIRDVTIENASLVILNFTIQFLEPGDRQAILNKVYQGLNPGGALVLSEKFSFEDAHVGELLFNMHHDFKRANGYSELEISQKRSMLENVMLTDSVETHKARLRQAGFEHAELWFQCFNFGSLVAVKAGEQA

SEQ ID NO: 14229 - protein, 70 aa, Klebsiella pneumoniae
EYSLNEIKKTLKRGNLRFVTPLFVQTTRAEIVRRWQGLAGFRLVIRYKYLTTRFVVEENGISYFISNVSG

SEQ ID NO: 14230 - protein, 279 aa, Klebsiella pneumoniae
SPPRPSGANCTASGKQPLMIELLLPGWLAGMMLACAAGPLGSFVVWRRMSYFGDTLAHASLLGVAFGLLLNVNPFYAVIAVTLLLAGGLVWLEKRPHLAIDTLLGIMAHSALSLGLVVVSLMSNVRVDLMAYLFGDLLAVTPQDLIAIATGVVIVIGILLWQWRNLLAMTISPDLAFVDGVKLQRVKLLLMLVTALTIGVAMKFVGALIITSLLIIPAATARRFARTPEQMAAVAVGVGMLAVTGGLTFSAFYDTPAGPSVVLCAAVLFILSMTKKAAS

SEQ ID NO: 14231 - protein, 546 aa, Klebsiella pneumoniae
NKPRLTTRPVDRVSHMQTAQKVITAYRHKRIIVCLLVALATLGATLAIRFISQRSVNEDYIRTAASQRVAALNDILRPLSAQRATLLPLVGKPCPDIHLTLRKMAASLQTIRSVALVTSGIVYCSSIFGPRQADLHRLQPALPAPRPLLLFSNDSSLLKGSPVLIQWYPAAESGLDGVMLVVNIELLGTLILNEKSALISDVSLQVGDRYFSSRHGLLEKAHVPQGTVIYRQRSTEFPFTVNINGPGASAIALEELPGELPLALIFSLLMTGIAWLATAGRMSFSREISLGISAREFALWCQPLQDARSGLCCGVEILLRWNNPRRGTISPEVFIPIAEGNNLIIPLTRYVIAETARRLDAFPRDRHFHIAINVAARHFANGLLLRDLHNYWFSVDPVQQLVVELTERDVLQDGDQHMAEHLHFKGVQLAIDDFGTGNTSLSWLEKLRPDVLKIDRSFTSSVGIDSVNATVTDIIIALANRLHIVTVAEGVETLEQENYLRSHGVDVLQGFYYARPMPLEAFPAWLASREESEGEGEGEGESETTE

SEQ ID NO: 14232 - protein, 181 aa, Klebsiella pneumoniae
TSPLKKNAPPGRAARPFYAVRCSRTASARHCTPPDGQKSPPASGDYPLRGPPAGCDSGALRNRAQRSGSSPPSAPPAIGSPAGSHRSGSATASAGASEPADPRGQPPEGPPPPSRRVRPAATAPPATGPGSVGGGWHTSEKSCVQPCSPPACSPKPGWAFTATARRLKWRRHSPYPRTRNP

SEQ ID NO: 14233 - protein, 70 aa, Klebsiella pneumoniae
GITLLILYLPHITGFYCYFKRQKNAFASIWLSFMAMSVHTKWKVIENSQLPGSYFLTILIQKAQKTQQIT

SEQ ID NO: 14234 - protein, 389 aa, Klebsiella pneumoniae
YFLRHSMTPGFTSLRNIRMSLKLKTMTLHVVIAGCMSMAFYAQADVKIGVAGPFTGPNATYGAQYWKGASQAVADINAAGGIKGEKIVLVQGDDACEPKQAVAVANRLVDEAKVSAVVGHFCSSSTMPASEVYDEAGILTITPGSTNPQITERGMKDLFRMCGRDDQQGAIAANYMLDVLKAKKIAVIHDKDTYGQGLADATRAALAKRGTKEVLYEGLSRGEKDFNALVTKIGALKPDVVYFGGCHPEAGPLVRQMREQGVQAKFFSGDCIVTEELVTAAGGPQFTNGVLMTFGQDPRTLPDGKAVIEKFRASGFEPEGYTLYAYASIQAIAAAWNAVGTDNAKASDWLKSHDVETVMGKKAWDGKGDLKVSDYVVYQWDDKGKYHQL

SEQ ID NO: 14235 - protein, 342 aa, Klebsiella pneumoniae
HCLRRATAEEMQSWQANCKSQCIILPALTLAFLTGGKMNLRRLKYFVKIVDIGSLTQAAEVLHIAQPALSQQVATLEGEMDQQLLIRTKRGVTPTEAGKILYTHARTILRQCEQAQLAVNNVGQTLRGQVSIGLAPGTAASAITMPLLQTVRNELPEVMVYLQESSGTALNDKLLAGQLDMAVLYERSPVAGIVSQPLLKEDLYLVGTRDCPGQSVDLTAVAEMNLFLPRDYSAVRARVTEAFTLRRLSAKIIGEIESITTLTAAIASGMGATVLPESAARSLCGAANGWMARISTPSMSLSLSLNMSARGSLSPQAQAVKEILLSLVSRPSLENRELQLVS

SEQ ID NO: 14236 - protein, 72 aa, Klebsiella pneumoniae
IQTLRREWRSGGGDEKDYLRLEKLNGFLLHIMSPNMMIARTRPLPIKQGLFLSRFFRQRLLGFRFGGNDHSP

SEQ ID NO: 14237 - protein, 233 aa, Klebsiella pneumoniae
PPMRILAIDTATEACSAALWNDGTLSAHFEICPREHTQRILPLVQEVLTESGTTLSELDALAFGRGPGSFTGVRIGIGIAQGLALGAELPMIGVSTLATMAQGAWRKTGATRVLAAIDARMGEVYWAEYQRDEQGVWHGEETEAVLKPDAVAERLAQLSGEWATVGTGWQAWPDLAKASGLTLSSGEIELPAAEDMLPLACYLLAAGKTVAVEKAEPVYLRNEVAWKKLPGRE

SEQ ID NO: 14238 - protein, 255 aa, Klebsiella pneumoniae
KGALFGEFFMAGHSKWANTKHRKAAQDAKRGKIFTKIIRELVTAARLGGGDPASNPRLRAAVDKALSNNMTRDTLNRAIARGVGGDEDANMETIIYEGYGPGGTAVMVECLSDNRNRTVAEVRHAFTKTGGNLGTDGSVSYLFSKKGVISFEKGDEDTIMEAALEAGAEDVVTYDDGAIDVYTAWEEMGAVRDALEAAGLKADAAEVSMIPSTKADMDAETAPKLLRLIDMLEDCDDVQEVYHNGEISDEVAATL

SEQ ID NO: 14239 - protein, 122 aa, Klebsiella pneumoniae
TQARRFAIKFGRDVIAQPIFPGDGDQLRRKVGTKYLGVSVATGACQRASSHHAIYMDISVSDKFRTGTHMICNNKITVWRINALTGTYRLINQTRFCDLTSNWRRRGGFGRCRTRGFFFPFG

SEQ ID NO: 14240 - protein, 137 aa, Klebsiella pneumoniae
GWARWRCWPSVCLPPGNLIELTGKIMKKIVLTMLLLASSGAALAAPQIITVSRFEVGKESWAFNREEVMLTCRPGNALYAINPSTLVQYPLNEVAEQQVKAGKTTAQPISVIQIDDPQHPGQKMSLAPFIERAQKLC

SEQ ID NO: 14241 - protein, 489 aa, Klebsiella pneumoniae
NKERIMNIKAASLTPEQALAELEARYEASVTALRKAIGDYIDHNTLPDTEARAEGLFVYPQLSVSWDGADHKALKTRAWGRFTHAGCYTTTITNPKLFRNYLLEQLTLLYQDYGAHISVELSQHEIPYPYVIDGSTLTLDRSMSAGLTRYFPTTELSQIGDETADGLFHPTEFYPLSHFDARRVDFSLARLRHYTGTPAEHFQPYVLFTNYTRYVDEFVSWGCSQILDPDSPYIALSCAGGIWITAETEAPEQAISDLAWKKHQMPAWHLITHDGKGITLINIGVGPANAKTICDHLAVLRPDVWLMIGHCGGLRESQAIGDYVLAHAYLRDDHVLDAVLPPDIPIPSIAEVQRALYDATKQVSGMPGEEVKQRLRTGTVVTTDDRNWELRYSASALRFNLSRAVAIDMESATIAAQGYRFRVPYGTLLCVSDKPLHGEIKLPGQANRFYEGAISEHLQIGIRAIDLLRAEGDHMHSRKLRTFNEPPFR

SEQ ID NO: 14242 - protein, 273 aa, Klebsiella pneumoniae
MRQLRYFIHINKIYVLVFCIYNNDYQSGVICTAMRDNDFFSWRRDMLHQFQSMATGEEVYNLLQRETEALEYDYYTLCVRHPVPFTRPRVTFQSTYPRAWMSHYQAENYFAIDPVLRPENFMRGHLPWNDSLFRDAPALWDGARDHGLQKGVTQCLTLPNHAQGFLSVSANNRLPGGYPEDELELRLRTLTELSLLTLLRLEDEMVMPPEMKFSRRELEILKWTAEGKTSAEVAMILSISENTVNFHQKNMQRKFNAPNKTQIACYAVATGLI

SEQ ID NO: 14243 - protein, 309 aa, Klebsiella pneumoniae
  UNSURE (22),(24),(31),(34),(38): Identity of amino acid at the above locations are unknown.
KVQLQKLKNKTSTSIIIDLRSXAXEALTERXSLXGLFXPSGPVVQVRDNNGKVREDSDNDGVVYYKGPLVVLVDRFSASASEIFAAAMQDYGRALIVGEPTFGKGTVQQYRSLNRIYDQMLRPEWPALGSVQYTIQKFYRINGGSTQRKGVTPDIMMPTGNEDRETGEQYEDNALPWDSINAATYVKSGDLTPFGPELLKRHDERIAQDPEFQYIMKDIARYNAMKDKRNIVSLNYAQREKENEEDDAIRLARINDRLKREGKPPLKKLDDLPKDYQEPDPYLDETVHIAVDLAHLEKARPAVEPPASK

SEQ ID NO: 14244 - protein, 63 aa, Klebsiella pneumoniae
QENSTYTRIRLHAWGAERITESKNPAQVSLSGIFKFGSSDWTRTSDIRINSPPFYRLNYRGIV

SEQ ID NO: 14245 - protein, 81 aa, Klebsiella pneumoniae
ATLSEGVMMKHQLTGQTGDDLDVNVDALLAAINEISESEVHRTLDDPQRASIDGRGSHTWRELAEAFELDIHDFSASEANR

SEQ ID NO: 14246 - protein, 119 aa, Klebsiella pneumoniae
AGIRANEREKMKPLFVYGTLCPGRSNAHILEAIGGEWRPGYVTGTFYARGWGAAADFPGIVLDAHGPRVNGYLFLSDRLAAHWPMLDDFEEGYDRVPVEVTTDDGQQISAWIYQLQPRG

SEQ ID NO: 14247 - protein, 425 aa, Klebsiella pneumoniae
RRIREISVTRINPLRALQAQRGTKSLVTLNFNRQAAARGFAVLGVHVFTGFIHGLDHLIERDARFAGAAHRHSRGVDRLDGSDGVTFNAWHLHLAGDRITGQAEVVFHADLRRHANLFRAGAEQFSQARRRHRAGDAHLALTADFRAGNGRIHLIQRADRPAGHKVANIDLRADGLDKVIVIGEYRRNDAAGAVGRRGYHATAGGVLFIDRQREHIDPVNNVHWIAGELIAGHQQTTQRRGATRYAQRARQHALGVHPAVDTGAHGLPDVGEIILDLFFAVQSQFVLHHHPGERQASLFAVGQHFLRRFKWVGHLQFVGVFLAEVLFVDNKAAADRVVGLAVDLFLAGPGVNGHAVFVQRQVVAAKTHAVIRREVDLVLAVGQQQTTARFDVTDKSRDRVNIDRIGLIARQSHDNGDVRMVAFAG

SEQ ID NO: 14248 - protein, 504 aa, Klebsiella pneumoniae
MTTSTETGSLNDILLVLQRRFCLFLHNLNTQLTERRRIGEAWRFGHQAGGRGGFRESDNVADVIGTGQQHGQTVKTEGQTCMRRRTVLQRIQQEAEFLTLFLFVNAQNTKYGLLHLAAVDTHRTAADFITVNNHIVGVGYSLFRGGFQLIRGHIFRRGERMVHRRQAAFAVVFEHREVDHPQRRPFALVSQTQVFTQLQTQRAQRVGHYFLVVGAEEDHVSILRAGAVKDRFHDFSGQEFGHRAVDPVHAFGTLGHFNIGQPFRAVDLHKVAVFVNQLAGQRGPARDAQGRHAPFRIVGRAGKDREFHRLQQVGDVHQLHRVTQIRFIGAIATFGFGEGHDRELAQVDAFHFQPQLTHHRLHDLTHLRRGHKGGFHVDLGEFRLTVGTQVFIAETFNDLIIAIEAGHHQQLFEQLRRLRQRVEFAFVHAGRHEVIAGAFRGGFSQHRGFDVEETMVVHKAAHKAGNFRAGFQALRHLRTTQVEVAVFQTRFFGVDVIGVQRQRF

SEQ ID NO: 14249 - protein, 266 aa, Klebsiella pneumoniae
GGNRVDNQISVPPALTGNYAFFFDLDGTLADIQPHPDQVVIPDSTLQALNALAQQQGGAVALISGRSMAELDALTHPWRLPLAGVHGAERRDINGKTYIVSLPTALRDEIAAELTSALEALPGCELESKEMAFALHYRQAPQQQSAVLELAQRIVQRYPLLALQLGKCVVEIKPRGVNKGEAITAFMQEAPFAGREPVFVGDDLTDEAGFSVVNQLQGMSVKVGAGETQAHWRLADAAAVRTWLQHLAYDAQTERRDDHESFSRSL

SEQ ID NO: 14250 - protein, 230 aa, Klebsiella pneumoniae
PPGSQWCGLSAVTIWPITGNCFASGFRPWRSGISRGPRGCSCIPRTLLSPRRWWIPCGVTCALPCRRQEMRRRFRSNLLFSDILLSYPEPSARVKGSFRMVSALYAVLGALLLVKFSFDVVRLRTQYHVGYGDGGFSELQVAIRVHGNAVEYVPIGLILLLFMEMNGAQTWMVHVCGILLIVGRLMHSWGFHHRVYYWRRSGMSATWCALLLMVLANLWYMPWELVFSLR

SEQ ID NO: 14251 - protein, 341 aa, Klebsiella pneumoniae
NCLRCKPWRAVSRAPEVLPDMLPAIAPRRTGRWRQRADKDAAMPVNFDFNDLYAFRALMEYGSFRLAAESICLSQSALSRRIEKLETALGNRLFDRTTRRVTLTLYGQNFAERSEQLLAHVETVLADISQVSKARTGLVTVATVPSAAYYFMPEIIRSFQARYPQVRIRLIDSSVGNVIEAVSSGQADFGLCFAKNLPASIEFTPLADDRYVAACRHDHPLARKTHLSWQAYFEQDYIGLDRVSGNRTLLDRELAHLTPARPSICETRHVTTMLGMVEAGIGIAAVPAMSMPAGEHSVLRAVPLTDPVVTRTVGLIRLSGRIQSYVAAELEKLIIEQYPSG

SEQ ID NO: 14252 - protein, 276 aa, Klebsiella pneumoniae
LCSSDDFASNMMFKWPWKADDESGNAEMPWEQALAIPVLAHLSSTEQHKLTQMAARFLQQKRLVALQGLELTPLHQARIAMLFCLPVLELGIEWLDGFHEVLIYPAPFIVDDEWEDDIGLVHNQRVVQSGQSWQQGPVVLNWLDIQDSFDASGFNLVVHEVAHKLDTRNGDRASGVPLIPLREVAGWEHDLHAAMNNIQDEIDLVGESAASIDAYAATDPAECFAVLSEYFFSAPELFAPRFPALWQRFCHFYRQDPLARRRENGLQDEGDRRIVH

SEQ ID NO: 14253 - protein, 504 aa, Klebsiella pneumoniae
PGKSTRLSTEENDMAVTQTAQACDLVIFGAKGDLARRKLLPSLYQLEKAGQIHADTRIIGVGRADWDKAAYTKVVREALETFMKEKIDEGLWDTLSGRLEFCNLDVNDTSGFTRLGEMLDQKNRVTINYFAMPPSTFGAICKGLGEAKLNAKPARVVMEKPLGTSLETSREINDQVGEFFEECQVYRIDHYLGKETVLNLLALRFANSLFVNNWDCRTIDHVEITVAEEVGIEGRWGYFDQAGQMRDMIQNHLLQILCMIAMSPPSDLSADSIRDEKVKVLKSLRRIDRSNVREKTVRGQYTAGFAQGKKVPGYLEEEGANKTSNTETFVAIRVDIDNWRWAGVPFYLRTGKRLPTKCSEVVVYFKTPELNLFKETWQELPQNKLTIRLQPDEGVDIQVLNKVPGLDHKHNLQITKLDLSYSETFNQTHLADAYERLLLETMRGIQALFVRRDEVEEAWKWVDSITEAWAADRDAPKPYQAGTWGPVASVAMITRDGRSWNEFE

SEQ ID NO: 14254 - protein, 224 aa, Klebsiella pneumoniae
LPLRGNYMYQRINGSDWRNIWLMGDLHGCFALLMNRLRQLRFDPWADLLISVGDLIDRGPQSADCLGLLRCRWFRAVRGNHEQMALEALESGDMRLWQMNGGDWYVKGDARQRADVDRLLAHCRRLPLIIEVQCEKARHVIAHADYPAPVYRWQQPVDPQRVLWSRHRLSEHLAGRHGAIGGADHFWFGHTPLQARYDHDNQHYIDTGAVFGGTLTLVALQSAG

SEQ ID NO: 14255 - protein, 229 aa, Klebsiella pneumoniae
TVMSEQKLIAESRTFEQQMIERDKRATKAGFVVGGMGLLIAVLALVAVVVMLPLKQTDVELYTLDNHTGRVEHVTRTSKTSLTATEAYQKAMAANYVKVRERYVYPSLQDDYETVQVYNAPQVNDDYLALYAGKNAPDKVYKNGAHTVKVEILSNQITDATAPDRVATIRYKKIIRRLADNSTRNEYWDARFTFHSNPDKEMSDAEREINYFGFTVTSWQTDREIRGGE

SEQ ID NO: 14256 - protein, 252 aa, Klebsiella pneumoniae
SEMSAIEVKSLVKKFHGQTVLHGIDLEVQKGEVVAIIGPSGSGKTTLLRSINLLEQPESGTIRVGDVTIDAGRSLGPQKGLIRQLRQHVGFVFQNFNLFPHRTVLENIIEGPVIVKGEDKQESMARARELLAKVGLSGKENSYPRRLSGGQQQRVAIARALAMRPDVILFDEPTSALDPELVGEVLNTIRQLAQEKRTMVIVTHEMSFARDVADRAIFMDQGRIVEQGEAKALFASPQQPRTRQFLEKFLMQ

SEQ ID NO: 14257 - protein, 511 aa, Klebsiella pneumoniae
VQKSGVVMQQSTPYLSFRGITMTFPGVKALSDISFDCYPGQIHALMGENGAGKSTLLKILSGNYIPTAGHLQIGGQQMAFANTMEALNAGVAIIYQELHLIPEMTVAENIYLGQLPHRGGIVNRSLLNYEARLQLEHLGLDIDPETPLKYLSIGQWQMVEIAKALARNAKIIAFDEPTSSLSAREIDNLFRVIRELREEGRVIIYVSHRMEEIFALSDAITVFKDGRYVCTFDDMPSVSHDALVQAMVGRNLGDIYGWKPRPYGEERLRLEEVKAPGVRTPVSLSVRSGEIVGLFGLVGAGRSELMKGLFGSTQITGGQVYIDGQPVSIRKPAQAIQAGMMLCPEDRKAEGIIPVHSVRDNINISARRKHIHAGCLINNAWEADNADQHIQSLNIKTPGPEQLIMNLSGGNQQKAILGRWLSEEMKVILLDEPTRGIDVGAKHEIYNVIYGLAASGVAVVFASSDLPEVLGVADRIVVMREGQIAGELLHEEANEQQALSLAMPTVSQAVA

SEQ ID NO: 14258 - protein, 60 aa, Klebsiella pneumoniae
EQESDGSPDSNDDGYTRDSQQGHHWHPPQRRRAFHCLEQLCHMFSLLAHQQSADFTASAN

SEQ ID NO: 14259 - protein, 286 aa, Klebsiella pneumoniae
FVRSSMSQQIESVKMALQELGINASGEFYYNPDYDLLIAHETSPELTGAARGVMTDSGAVAVDTGIFTGRSPRDKYIVRDEQTRDTVWWADSGLGRNDNKPLSPDVWRSLKSLVAGQLSGKKLYVIDAWCGASPDTRLGVRFVTEVAWQAHFVKNMFIVPSADELASFTPDFVVLNGAGCTNANWQAQGMNSENFVAFNLSERIQLIGGTWYGGEMKKGLFSVMNYLLPQKGIASMHCSANRGEAGDVALFFGLSGTGKTTLSTDPHRQLIGDDEHGWDDDGVFNF

SEQ ID NO: 14260 - protein, 598 aa, Klebsiella pneumoniae
GGFGMKLLRLKISDPSGFRSLPCGFEHYFRTEWDLQEELNQHEGFAPFVCAGPNGSGKSNLLEALAAIFFQLEILRVRRSFLPEVLQSTDHDLSPISFELDYLIRVPEEFRISGGQEWAKVSVWKNNGESVRFHWVNQSDFDTNADEVFKGSHADILLPQYVLGYSSGENEILSLPFFKMRFVQFDEYWNALTRQLSYSGHPESRLAYLDSGFSQAILLCNLLFQNETALQPFREDVGIEALREFRIIIRRSIPLAPEQLTSFASEDKNQHQSLDDILNSNPALHVDMDEESGQSYHLNLMQLLEGDDKSSLVVSALKRCASLYYEDECNDTLILDYWVNDATRQAFRENFNGSALALFQAFQVLLTLNLYKVSDNLKTDLYRSTSHYVSETVPTLASDERIMRFKFVRFTKQGVEEPMMLKELSDGEHQLLHSLGLCLLFRETNSLFLLDEPETHFNPHWRASFITRMRQCLCNTENVEQEMLITTHTPFLISDSKPEKVLVFSKDKYSGAVTISIPKYNTLGASINKITMNTFGKRETIGGHAQAVLDDLRRRFNEGIEDKETLITEIDEQLGDSVEKVLLLKAIFDSDNPTNDEV

SEQ ID NO: 14261 - protein, 358 aa, Klebsiella pneumoniae
YMSGGLFVGVEKYLIGGITDATKRLMMSYSSMMMGLAAASATIYIMWRGYQTLAGKLSTPMEDTMWDIMRMAIILSFVANLGGYLDGVIDAINGIKEGFSGSDNIWQLLDTLWNKAKVLGKTLHDMDNSTYVKDEGMTAQFCVWLGIFALMILAGFVSMVAEVMILLLGITAPIFIFCLMYGFLRPMFNNWLQNIFAGILTILFTALSLRIVVNYLNLVLNKATKVADSSTIVELGAQVCLAGIFAAILVYISAKVAAALAGASATVSMQGLAAVGIGAAAFGAGKLAGGAVKETKRSAQDNIQGWKDANAGKPGKPGGELGYNASKARKYAIEQMIARNEARRLAQSRESAVKKFNS

SEQ ID NO: 14262 - protein, 181 aa, Klebsiella pneumoniae
MNTGPLNENELEWLDDTLAKYAAEGAILDVSELDGLLTAILSAPTDIEPAQWLLAIWGGADNVPRWANDRERDRFVNLTLQHMSDIAERLESYPDQFEPLFGTREAEGQELTIVEEWCFGYLRGVALSDWSTLPAELQPELDAIALHGSEEQFSALDNLTADEFIASIERITPAALALYQY

SEQ ID NO: 14263 - protein, 182 aa, Klebsiella pneumoniae
YLAGCRDVWCIYQMSIDVETLVKQLGKPYQDIYKQGLVPYETKPSVTVSDDIYRLDMKREGVFLSFFNNQDKNLKEVALRLEDENKTDWLFPNLLPFGLEPVMTQRWVRNRFGHPITYVAANVIMTIYVGVEQTYILPTPNQNIAAAFSYNNVLFVNRITFIPVERAKEIQSALEKKRLGGK

SEQ ID NO: 14264 - protein, 224 aa, Klebsiella pneumoniae
TLCGTALMNTSESDLINKTFYPGWLMVSQLRCGQPVTDGEALYRQACRWVTEAREALTAGGVSEASAEQMLYAYCALLDESVLNRASQDDGYRRWRKDPLQARFFSTLNAGEELWERIRQLLREPTADAAVLTCFFRTLQLGFVGQYRAEDDERREDVAQALGARVPPFSLTQEAPVVVRASRLRSGRRMYWCAWAAGIVALAALWLTCSAMLSQMVAQIAGQG

SEQ ID NO: 14265 - protein, 111 aa, Klebsiella pneumoniae
MLCGPARRMSLALTALYYLENKLSNFMKSCFKIYAVLHTFASSPCLLTSALCMLAHPLRPPLPPAGDKVLTAQAIMNNKLKAFSFIIKLPMRVIPISILNKTFLNLLFANN

SEQ ID NO: 14266 - protein, 124 aa, Klebsiella pneumoniae
GHGGHSAPPETASSPGPSARAGSEKSASPPAAPAPGSAHPAAAGAVGSSAPGRWPASAARRRRGSSPAVPAALPAGGTAGTFAPCPRPDSGCQWQWSPLADSPRRSYRERCAALPGPGRCRCWR

SEQ ID NO: 14267 - protein, 251 aa, Klebsiella pneumoniae
IAGGGGYAAVSLLPAGGGENRGRGESGAGLFAKRGGVEETSRPRVNLSNKKTEKRSRIMAGQKQGVRWLLAAAVAVALSGCVSVPDAIKGTSPTPQQDLVRVMNAPQLYVGQEARFGGKVVNVQNQQGKTRLEIATVPLDSGARPVLGEPSRGRIFADVNGFLDPVDFRGQLVTVVGPIAGVVDGKVGSTLYKFMLMNATGYKRWNVVQQVVMPPQPIDPWMLGPRPWGYGYGGWGWYNPGPAEVRNVVTE

SEQ ID NO: 14268 - protein, 411 aa, Klebsiella pneumoniae
SGSGHAEYNMTEFPVVLVINCGSSSIKFSVLDAASCDCLLNGVAEGINAERASLSLNGGEPVALAQRGYEGALQAIAGALAQRDLIDSVALIGHRVAHGGDLFTESVIISEEVINNIRQVSSLAPLHNYASLSGIASAQRLFPEVMQVAVFDTSFHQTLAPEAFLYGLPWEYYQNLGVRRYGFHGTSHRYVSHRALSLLGLPEQESGLVIAHLGNGASICAVRNGRSVDTSMGMTPLEGLMMGTRSGDVDFGAMAWIAGETRQTLSDLQRVANTASGLLGISGLSSDLRVLEQAWHEGHARARLAIKTFVHRIARHIAGHAAALQRLDGIIFTGGIGENSVLIRRLVSERLTVFGLAMDAARNQQPNSAGERLISADGSRVRCAVIPTNEERMIALDAIRLGRIHTAAALA

SEQ ID NO: 14269 - protein, 523 aa, Klebsiella pneumoniae
RKSGLSSPFLLDISHTAKVSLLTSGAWKMKNPTLLQCFHWYYPTGGELWPEVEALAPSLNEIGINMVWLPPAYKGASGGYSVGYDTYDLFDLGEFDQKGSVATKYGDKAQLLAAINALKEHNIAVLLDVVVNHKMGADEKEALRVQRVDEQDRTQIDEEIIECEAWTRYTFPVRAGQYSQFVWDYKCFSGIDHIENPTEDGVFKIVNDYTGEGWNEQVDDELGNFDYLMGANIDFRNHAVTEEIKYWARWVMEQTGCDGFRLDAVKHIPAWFYKAWIEHVQEVAPQPLFIVAEYWSHEVEKLQQYIDLVEGKTMLFDAPLQMKFHEASRQGRDYDMSQIFSGTLVEADPFHAVTLVTNHDTQPLQALEAPVEPWFKPLAYALILLRENGVPSVFYADLFGASYEDTGGDGETYAIEMPVIEQLHELIDARQRFAHGVQTLWFDHPNCIAFSRSGTDDDPGCVVIMSNGDEGEKALTLGENYGNKRWRDFLGNREEIVETDGEGCATFTCNGGSVSVWVLEEVL

SEQ ID NO: 14270 - protein, 120 aa, Klebsiella pneumoniae
SPTGAHMSSLLIPADWKVKRSTPFFTKENVPAALLSHHNTAAGVFGQLCVMEGAVTYYGFANEQATEPEKKVVIHAGQFATSPPQYWHRVELSDDARFNIHFWVAEETDGENGLFHAKKA

SEQ ID NO: 14271 - protein, 342 aa, Klebsiella pneumoniae
SARGLSLSVARFKIGGNHNEVFIVTDNSLHSSGVLAPRSHLIADLVMGRLTPAPIWRQKNYRFKFLLRTALFYNATRAMLEALSARDDFNQLLAAQATLPGKVHRQYLTRDLNAWQRAVAVINHYRYIDTLRGSRLAHAMTAVSEVPLLTLNGKEDRRFTLYASSAGKAEREGETTLWLRDSDHTLLASATFSVTRDHDAWQLVIGGLQGPRRHVSHEVIKQATRACYGLFPKRLLLEFIWQLAAHSQIAAIYGVSDNGHVFRALRYRLSKGRHFHASYDEFWQSIDGQPESPWRWRLPLCLERKSLESIASKKRAEYRRRFQLLDQLTEQVAILTQRHAGD

SEQ ID NO: 14272 - protein, 240 aa, Klebsiella pneumoniae
  UNSURE (3),(46): Identity of amino acid at the above locations are unknown.
QAXGEEREIGITELSQRVMMSKSTVYRFLQTMKSLGYVAQEGESEXYSLTLKLFELGARALQNVDLVRSADIQMRELSRLTKETIHLGALDEDSIVYIHKIDSMYNLRMYSRIGRRNPLYSTAIGKVLLAWRDRSEVEQILDGVEYKRSTERTITSTEELLKVLDGVREQGYGEDNEEQEEGLRCIGVPVFDRFGVVIAGLSISFPTLRFSEERLHEYVAMLHQAARKISEQMGYNDYPF

SEQ ID NO: 14273 - protein, 329 aa, Klebsiella pneumoniae
RISGAAVRRADGDDDDLAAARPGAHQPQRGCVAKRSRAMTDSILRVEHLMMHFGGIRALNDVNLEVERGSITALIGPNGAGKTTVFNCLTGFYRATGGSIVLRAREKVTDVIQVLGQKLHPDDFLHPAQLGRRIYYKMFGGTHLVNRAGLARTFQNIRLFREMSVIENLLVAQHTQVNRHLLAGILNTRGYRQAESQALDRAFYWLEVVEMVDCANRLAGTLSYGQQRRLEIARAMCTRPEMICLDEPAAGLNPVETQALSRIIRFLRQQHGITVLLIEHDMGMVMEISDHIIVLDHGDVIARGAPQAIQANASVIAAYLGAEEEETRR

SEQ ID NO: 14274 - protein, 129 aa, Klebsiella pneumoniae
SAGGRASFTGLYSPRFTTHEKKCKKKGLHNSRWLNALFMPIWSLSWTLPCAFKGARDVRYTMWVSMLGMWGCRVVAGYTLGIVLGMGVIGVWLGMVLDWAVRGVLFYFRMVSGRWLWKYPRVKASSEES

SEQ ID NO: 14275 - protein, 606 aa, Klebsiella pneumoniae
GAFMNSTMLRVTNRIIERSRDTRAAYLARINQAKTDTVHRAQLACGNLAHGFAACQADDKASLKSMLRNNIAIITSYNDMLSAHQPYEHYPEIIRKALHSANAVGQVAGGVPAMCDGVTQGQDGMELSLLSREVIAMSAAIGLSHNMFDGALYLGVCDKIVPGLTMAALSFGHLPSVFIPSGPMASGLPNKEKVRIRQLYAEGKVDRMALLESEAASYHAPGTCTFYGTANTNQMVVEFMGMQLPGSSFVHPDAPLREALTAAAARQVTRMTGNGNEWMPLGKMFDEKVVVNGIVALLATGGSTNHTMHLVAMARAAGIIINWDDFSDLSDVVPLLARLYPNGPADINHFQAAGGVPVLVRELLKGGLLHEDVHTVAGFGLSRYTLEPWLNNGELDWREGATAPLDDQVIATFEKPFSRHGGTKVLSGNLGRAVMKTSAVPVENQVIEAPAVVFESQHDVLPAFEAGLLDKDCVVVVRHQGPKANGMPELHKLMPPLGVLLDRRFKIALVTDGRLSGASGKVPSAIHVTPEAYDGGLLAKVRDGDLIRVNGQTGELTLLVDEAELAARQPHIPDLSASRVGTGREMFGALREKLSGAEQGATCITF

SEQ ID NO: 14276 - protein, 431 aa, Klebsiella pneumoniae
GGFMGEITRQPARAIQNALIDSVLAGLCALIVFGPIVGVVLKGYGFTLAPARVAILVAVVMAGRLALSLLLQSHRGKAFIARFEGADDGVYVRPPGYRSRLRWIIPLLVGLAIVFPFLATKYLLTVAILGLIYVLLGLGLNIVVGLAGLLDLGYVAFYAIGAYGLALGYQYLGLGFWAMLPLGAVMAALAGALLGFPVLRMHGDYLAIVTLGFGEIIRLVLNNWVSFTGGPNGVPVPSPTLFGLEFTRRAKDGGIPIHEFFHVSYNPNLKFIFLYAVLCLVVMLVLLVKHRLTRMPIGRAWEALREDEIACRAMGLNHVLVKLSAFMLGASTAGIAGVFFASYQGFVNPTSFTFFESALILAIVVLGGMGSTLGVVLAAFVLTVTPELLRGFDEYRVLLFGVLMVMMMIWRPRGLVRTSRSGVALRKGVAP

SEQ ID NO: 14277 - protein, 251 aa, Klebsiella pneumoniae
GALMLISSFHERQTRNNEKIKQLLNFLKEETYSDFKTLMLLFGFRDHKSLYSLLAKTERMGLIQKHVLESRTMKISLWGITSDGLAVVLTPDDKIFPPRFEPSKITGWTLEHHLDNQAARLILEKKGASGWINGDRATFLSQYQVKHRPDGLIILPGSTVIAIETERRLKTRARYQSIIASHLLARTRKLWIHVFYVIPDPQKKRALELLFDSIRHVIINHQHVPLEERHRRVFRIYTLDELKRLSLDSYT

SEQ ID NO: 14278 - protein, 308 aa, Klebsiella pneumoniae
QGIIMSQFYLVAPSGYCINQQAAARGVERLQQAGHEVAHQQVIPRRQQRFAGTEHERLADINQLAQLPGRNRIVLAVRGGYGASRLLPHIDWQGLVARQQRDPLLICGHSDFTAIQSGLLAMGNVITFSGPMLAGNFGAETLDPFTEHHFWQAIRQPEFTLEWPGEGPNCRVEGTLWGGNLAMLTSLIGTPWLPAIRDGILVVEDINEHPFRVERMLLQLLHSGVLAAQKAVIFGSFTGSAPNDYDAGYDLPQVFDYLRQQLPLPLISGLEFGHEQRTVTLPLGARARLVNQAAATTLTIGGHPVLTE

SEQ ID NO: 14279 - protein, 388 aa, Klebsiella pneumoniae
IRHIPEVNNMKVWPVKHSPLLRQPERFIARSELQALIRNVTQNLVNIKDESGQFLLRLDDGRVIDTKGWAGWEWTHGVGLYGIYQYYQQTGDIEMRDIIDRWFADRFAEGATTKNVNTMAPFLTLAYRFEETGRMAYLPWLESWAEWAMHEMPRTEQGGMQHMTLAEENHQQMWDDTLMMTVLPLAKIGKLLNRPQYVEEATYQFLLHVQNLMDRETGLWFHGWNYEGRHNFARARWARGNSWLTMVIPDFLELVDLPEGNAVRRYLITVLDAQIAALAECQDDSGLWHTLLDDPHSYLEASATAGFAYGILKAVRKRYVGQHYAGVAEKAIRGIVQNISPQGELLQTSFGTGMGSDLDFYRQIPLTSMPYGQAMAILCLTEYLRKYF

SEQ ID NO: 14280 - protein, 62 aa, Klebsiella pneumoniae
STNIIISPPVIIHAHTHRASNTLISHTFLSFLPVFIFPLKFHYPSCILTMLFNNMERAVTQP

SEQ ID NO: 14281 - protein, 60 aa, Klebsiella pneumoniae
LKNIASAILFPLAAEKYYSHGYISRLTLSFLLTIFSLINLNENRYHLVIKIALFCYCFIF

SEQ ID NO: 14282 - protein, 812 aa, Klebsiella pneumoniae
NRNIMDTSSIITGTTLNRYQLDIPSCTASLDVEEFSGAEKLSELYYYTITFTSAEKNIDAAQLLSKPAMLTMGGGALQQLADCKRVHGVVTAFRRISSSEDQSKYQITLEPFLSLLDKQFRSHRFFVNKSVPEVVEQVLQEHHLHDWEYEFYLKQHYPRREQINQYQESDLAFIQRLLAEVGIFYFFTLQEEAQSEVVHFADAQRALTFDKTLPVNSPSGMSDSGAESIWGLSITHNVVEANVTTRDYNPRDAQSVLQSATADMTRGNGEGITYGEVYHYKLRHRERGDKIDPQTETANFYARLDHERFLAHQTLITAISTAAWLAPAQVLTVTDSLPSTLPAPVQDPLLITGTGFTASRREALRVSLLAVPYSETLCWRPPLLPRPKVTGTMTARVTSAKANDIYAWQDASGLYRVKFDADREDKGQGQESMPVRLAKPYGGDVYGFHFPLIQGTEVAIAFHEGDPDRPYIAHALHDSRHVDPVTEKNSTRNVIRTPANNKLRMEDKRGEEHIKLSTEYGGKTQLNLGHNVNAQRELRGEGAELRTDKWVSIRGGAGVFISADKQPSAGDRMLAMEEAIAQLENALGIAKSLASAAESAQALPSDTGNQQTLNDALKELAQPGIVLNAPQGVSISSPQAVRLSSGSASVGIVSQQNTDISALKRFTVAAGEAVSLLARKAGMKLFAAKGKMEIQAQDDALEATAKKDITVTSVEGRVEITAANELVVNCAGAYIRLSGGNIELGCPGNILLKSANVQKMGKADFRVPPLELPKGFEQRFTVKDQKTGEIVPFARYRITTVKRPGIRRPGRC

SEQ ID NO: 14283 - protein, 446 aa, Klebsiella pneumoniae
GQDMSTTESIASSQTSLSSWRKSDTTWTLGLFGTAIGAGVLFFPIRAGFGGLIPILVMLVLAYPIAFYCHRALARLCLSGANPSGNITETVEEHFGKTGGVVITFLYFFAICPLLWIYGVTITNTFMTFWENQLQMPALNRGVVALLLLLLMAFVIWFGKDLMVKVMSYLVWPFIASLVVISLSLIPYWNSAVIDQVNLSDIALTGHDGILVTVWLGISIMVFSFNFSPIVSSFVVSKREEYEAQFGREYTERKCSQIISRASMLMVAVVMFFAFSCLFTLSPQNMADAKAQNIPVLSYLANHFASMSGTKSTFATLLEYGASIIALVAIFKSFFGHYLGTLEGLNGLILRFGYKGDKTRVSSGKLNTLSMVFIMGSTWVVAYANPNILDLIEAMGAPIIASLLCLLPMYAIRKAPSLAKYRGRLDNLFVTAIGLLTILNIAYKLF

SEQ ID NO: 14284 - protein, 112 aa, Klebsiella pneumoniae
FSIFQGNDYVAIFKPVLKGTRCLAPDGVDRFYSRTRCAVVPACDAAAAVCHVYLRTLRAVRHHGRGAGRRHRPQNAAALCRHGDLVVQRNTWTAAGVGAYDDPAAPFAVPDL

SEQ ID NO: 14285 - protein, 400 aa, Klebsiella pneumoniae
RSIFLDYENLHRFAAAAGRHADGRHFQHPAMLHDHIFDFVRIDVKTRHQDHIFFAIDDAQEPLFIHHRDIPGVQPAVFDNLIRRVRALPVAQHHLRTFNTELARLTRRHFVIIIIHQFGFGGRHRQANAAAVVVNIVRVNADQRGTLCQAVALQQILPGQFYPALGHRLLHRHPTAGGQMQRGEIKLLELFVVQQGVEQGIDPGHGGKRILRQLLHQPGDIAWVGDQQILPAQFDKQQAVHGQGENVIQRQRGHHELFAAMQQRAVGGIDLLEVSQHIAVGEHRAFGHAGGAPGVLQKRQIFRNDLRLDVLHAIAVLQRAAKRDGVRQMVLRHQALNVLDHKVHQRTFGGGKLVAHARQDHMLDLSFRHHFFQGMGKVGDYDDRRRAAVVELMLQFARGI

SEQ ID NO: 14286 - protein, 104 aa, Klebsiella pneumoniae
GFIMKKTVIAATVLCLTAGTPIYSFAADPCEVVLCMYGKATGNSGGSECSSAERAFFKINAFKKHHRFNPGKTFDMRKEFLGECKAADPESISKILSKFGRVKG

SEQ ID NO: 14287 - protein, 310 aa, Klebsiella pneumoniae
MDVISIIMAAGKSSVDVALYTLLPIMVIMLIIMKYLEVRGILDVIVRWVAPLLKPFGLTGMSAFALIQINFVSFAAPLATLSIMDKRGVSDRQMAATLAMVFAMGQGNVFYPLTPFGLHWLASIVISVVGGLCAAAVAWHVTGRRLSVAESPRAEALPNAEQNSQGILAVINSAGSDAIRLALGAVPMLILSLTIVGLLQGAGAIDLLQQLLKPLLSWLHIPQNFVLPALVKCVAGGTAYFGVISELIQQGKVTVDQVNASAGLLIQTFDLPGIGIFLGISSRFVRLFRFVAPAAIVGILLRTVLHLILF

SEQ ID NO: 14288 - protein, 210 aa, Klebsiella pneumoniae
GWVMSTMIMDLCSYTRLGLTGYLTSRGIKKQEIIEVNSAADLQKHCTSCCPAVVFLNEDCFVHDDESNGIIRQIITQNPATLFVIFMSLANIHFDRYLRVRKNLLISSKSITPKDLDVILVNYLKYKNTSVGQLTLPTLSLSKTESNMLQMWMAGHGTSQISTQMNIKAKTVSSHKGNIKKKIQTHNKQVIYHIVRLTENITSGIQVNMR

SEQ ID NO: 14289 - protein, 96 aa, Klebsiella pneumoniae
RRTITTDQQAAAPRTQPAMPDLKSQDLVTHSFHHLKEKAFILPPAAQKEISRQKNVLPRNKFINSANAAEKLNILVAHYVKHLSPQQQAACYDDYQ

SEQ ID NO: 14290 - protein, 78 aa, Klebsiella pneumoniae
RLAIFPLAAQKHSVFLPSCSTPCQGRWEAVYTAVGVNSAKTCRGGVTPPREWAKRGGSREVEPPRQPMLYCIRNFSRN

SEQ ID NO: 14291 - protein, 470 aa, Klebsiella pneumoniae
TSAIIIIRFTARHRLSDARRQEFRHRGEDRNHHRVAKLTIGLRIRYRDAKTRPLRGFKAHQPGAFARRQPARPPLLIQRIVKMLLTERPVPAAIDENFGTIFIVAGRKRPGHAVGIGGVNQAITKAIAPRLMLAGITIKIFPQHRRKNKFRIDRRLQQLAKCWPHRRVLRRDVAQRKSSMQLQIATETHQHDALPVLRQEMAPVNHLRVIRPGMPRVSYFISQLIQRLHDDTEGAPLIVAFEVFDILQHKNRWLTSRDNSHHVKKQRSLGFAGKAMRTAHRIFLRDAGKRERLAGEASQQHIMLRDRFANMPRRLLVANVRALAEGNIADIFIKTVLLRITVPVGLIGAYRVLVPLAGENALPADGFKTTADPANTGKQIDKTEPIVRMMGRRRRQERRQMSNFLRAQTLRHAAKRHHALEDRRAPVLFADAHQFGNQRFYIVDRHQLTQQRLSVFPGLFSQRQRPVFLA

SEQ ID NO: 14292 - protein, 404 aa, Klebsiella pneumoniae
TPAITRIQHRAVYPWNALRDRKTEHRDGLLAQRAGSAVEDRANDAAGIAQRQAFALAVPAGVDQPGFGTGFRHLRRQDAGVLGRVKQQERRAIAGGEGRRRLGNAALGARQLRGETRQEMVLHLLGGQTGDRRQDAKRIGGKENHLRRMARAGHRLDDIVDMRQRIGDAGVFGFAAVGIIHAAVSAHHHVFQQRIAADGAINLRLRLRIEIDGLGVAAALEVKHAVIVPTVLIIADQLTMRIGRQGGFPGPGEAEEQRHVPCFATVGRAVHRRDAFLRQQVVHDREQPFLHFAAVPGTADELNTLAQIKGDKVLGVHPLRLPVGIGAARAVEHHEVWRKAGQLVGAWHDEHVFDKVGLPRHLGDEAYAKTGVRAGAAPGVDDVQFFAAQLARDQAFQAAPHVWR

SEQ ID NO: 14293 - protein, 359 aa, Klebsiella pneumoniae
GACMTRPVVASIDLLALRQNLQIVRRAAPGSRLWAVVKANAYGHGVARVWSALSAADGFALLNLEEAILLREQGWKGPILLLEGFFHADELAVLDQYRLTTSVHSNWQIKALQQAKLRAPLDIYLKVNSGMNRLGFMPERVHTVWQQLRAISNVGEMTLMSHFAEAENPQGIVEPMRRIEQAAEGLDCPRSLANSAATLWHPEAHFDWVRPGIVLYGASPSGQWQDIANTGLKPVMTLRSEIIGVQNLRPGEAIGYGGLYRTTQEQRIGIVACGYADGYPRVAPSGTPVLVDGVRTTTVGRVSMDMLAVDLTPCPQAGIGAPVELWGKEIKIDDVAASSGTVGYELMCALAPRVPVVTL

SEQ ID NO: 14294 - protein, 118 aa, Klebsiella pneumoniae
PGRMPGPFALPPCHSPQLIVWCFCQAIFVIFLHCTVLCLRISRKPSPSFAAVKPHRVKTFGDDLGIRPLLFVVCTWFRSVKYDPDHVMKKNNIISRHSSPLALAEGYILAKTPNDFTH

SEQ ID NO: 14295 - protein, 260 aa, Klebsiella pneumoniae
PPLILFPRHAVSADPACHLFTEVTMLSTTAFLAIAMQCAASIHPSTAFDVARVESGFNPYAIAEIVPKAGPSFGDQHIISHLPASRGDAEHILRRLSAQDRRYSVGLMQITSTNFRHYGVSATELLDPCTNLSVFEHILRDCYRRGGTLKRALSCYYSGNFSTGQQPETAFSGTSYIQRIGYPPGSSRYAVPGTREDKSSVAVPLKTAPASDSSRHHVFWPGVVVRGVPAKLRQEKIFIAPFSAPSVRRSFSLSPREEEE

SEQ ID NO: 14296 - protein, 544 aa, Klebsiella pneumoniae
MSLIAIVLVFIMAIVVTVFLSHLLPVKVPLPLIQIAAGAALAASGFQVDFDPHIFLLLFIPPLLFLDGWRIPKDAFFRDMKPILSLAIGLVMVTILGIGLFIHWLIPAITVAAGFALAAILSPTDPVAVSAMTASSPLPSRMAHILEGESLLNDASGLVAFNFAIAAVLTGSFSPGDAVVKFFLMAFGGILSGLVVVWVTGKCNNFLVRRTREEPAIQILISLLIPFAAYLLAEAFHVSGILAAVAAGIAMHYEQLSGPRLPATRMKSSAVWSMLQTTLNGMIFLMLGEQLPRMLRTLPAVASQAGVSSPWYLLLYAVAITLALGLMRFAWVWLSMKLTIFRRKRRGKAITVRPRFSILAVMALAGVKGSVTLAGILTLPVVLADGSPFPGRELLIFLSMAVILMSLVVAAIGLPFMTRYLADDLPHDTGKDDIGAVMTEVAINRLNALLDEPVEDPSEQALRADAGNMLLETYQRRLHYNDNDEGQDVGLELAKRARLEKYMQREVIIAQRQELFRLRRAHNISDITFYEVLREIDLKEESLR

SEQ ID NO: 14297 - protein, 63 aa, Klebsiella pneumoniae
LRIMFQRIGFPGVTNFQVLLALASLIPTPASRDFFRLPLTVGFTGAEIVNIEFECLRQLTPGM

SEQ ID NO: 14298 - protein, 392 aa, Klebsiella pneumoniae
FIVIIIKREYIMKRKVLALMVPALLMASAANAAEIYNKNGNKLDLYGKVDGLHYFSDDASEDGDQTYVRFGLKGETQITSELTGYGQWEYNIQANTSEKEGANSWTRLGFAGLKFADCGSLDYGRNYGVVYDIESWTDMLPEFGGDTYTQTDVYMTGRTNGVATYRNSDFFGLVDGLHFALQYQGNNENAGSGEGTNNGGKRKLARENGDGFGISSYYDLDMGISFGAAYSSSDRTHNQLAAARSSQRYANGDKADAWTVGAKYDANNIYLAAMYAETRNMTFYGNDSFGGIANKTQNFEVVAQYQFDDFNLPLRPSVAYLQSKGKDLYAYSRYGDKDLVKYVDVGMTYYFNKNMSTYVDYKINLLDEDDRFYKNSGIATDDIVALGLVYQF

SEQ ID NO: 14299 - protein, 231 aa, Klebsiella pneumoniae
RDSIRRDHRYITAVRIAQPLSGSAYVYWGQRCVIWIIPGQDTHMNLSATILLAFGMSMDAFAASIGKGATLHKPKFSEAVRTGLIFGAIETLTPLVGWGLGMLASQFILEWNHWIAFILLVFLGGRMIVEGFRGDSDEACEAPHRHGFWLLVTTAFATSLDAMAVGVGLAFLQVSIVTTALAIGCATFIMSTLGMMVGRFIGPLLGKRAEILGGIVLIGIGSEILWSHFAG

SEQ ID NO: 14300 - protein, 435 aa, Klebsiella pneumoniae
GMKISEFLHLALPEEQWLPTISGVLRQFAEEECYVYERQPCWYLGKGCLARLHINADGTQATFIDDAGEQQWAVDSITDCARRFMAHPQVKGRRVYGQVGFNFAAHARGIAFNAGEWPLLTLTVPREELIFEKGNVTVYADSADGGRRLCEWVKEASTTTQNAPLAVDTALNGEAYKQQVARAVAEIRRGEYVKVIVSRAIPLPSRIDMPATLLYGRQANTPVRSFMFRQEGREALGFSPELVMSVTGNKVVTEPLAGTRDRMGNPEHNKAKEAELLHDSKEVLEHILSVKEAIAELEAVCLPGSVVVEDLMSVRQRGSVQHLGSGVSGQLAENKDAWDAFTVLFPSITASGIPKNAALNAIMQIEKTPRELYSGAILLLDDMRFDAALVLRSVFQDSQRCWIQAGAGIIAQSTPERELTETREKLASIAPYLMV

SEQ ID NO: 14301 - protein, 99 aa, Klebsiella pneumoniae
GGEMSELLNPGILNLASLAVSVALLLVGLLLWFFVNRASSRANEQIELLQALLDQQKRQNALLRRLCEANAPEKEDVAEPTVAGKAKGEDEFIRLVAER

SEQ ID NO: 14302 - protein, 101 aa, Klebsiella pneumoniae
GGGIMILFRKLKAVVPPVSACTLTTFSATPALADGFQRANTVMQKVSPGLHGLAAITITVPVIWIGYKTLWKGESLSQCGYIIIGGILIGGGSEIGALLMS

SEQ ID NO: 14303 - protein, 130 aa, Klebsiella pneumoniae
QKGMTNMRLLAGRALRLSVALAGMLTAAGAFAHAHLQQQIPTAGAQLSASPQTLTLSFSEGIEPAFSGVTVTGPQQHAVATGKLTRSADNPAEVTLPLAEALPPGEYTVAWHVVSVDGHKTKGQYTFSVK

SEQ ID NO: 14304 - protein, 617 aa, Klebsiella pneumoniae
IVVFGVRKNSSGNSVTPMSSQSSNTESLSRFPLWQVITPVRRKVILAMALAGLAALTSLGALLFLAWSLRDIRATPDAIPAWPLGGVIGCVVLTFVLRLQAFNTSHYAAFHLENILRSRLARKALQLPPGVLQQMGSGSVAKVMLDDVKSLHIFVADSTPLYARAIIMPLATIVILFWLDWRLAIATLGVLAFGSVVLVLARQRSEDMAQRYHKAREQVSAAVIEFVQAMPVVRTFDSGSTSFLRYQRALEEWVDVLKTWYRKAGFSARFSFSILNPLPTLFVLIWSGYGLLHYGSFDFIAWVAVLLLGSGMAEAVMPMMMLNNLVAQTRLSIQRIYQVLAMPELSLPQSDQQPQEASITFEQVSFHYPQARTGAALQEVSFHVPAGQIVALVGPSGAGKSTVARLLLRYADPDKGHIRIGGVDLRDMQTDTLMKQLSFVSQDNFLFADTIANNIRLGAPDTPLEAVIAAARVAQAHDFISALPEGYNTRVGERGVFLSGGQRQRITIARALLQDRPILVLDEATAFADPENEAALIKALAAAMRGRTVIMVAHRLSMVTQADVILLFSDGQLREMGNHTQLLAQGGLYQRLWQHYQQAQHWVPGGTQEEVVENERQ

SEQ ID NO: 14305 - protein, 324 aa, Klebsiella pneumoniae
QVTIAIVIGTHGWAAEQLLKTAEMLLGEQENVGWIDFVPGENAETLIEKYNAQLAKLDTSKGVLFLVDTWGGSPFNAASRIVVDKEHYEVIAGVNIPMLVETFMARDDDPSFDELVALAVETGSEGVKALKAKPVEKAAPAPAPAAAPKAAAPAKPMGPNDYMVIGLARIDDRLIHGQVATRWTKETNVTRIIVVSDEVAADTVRKTLLTQVAPPGVTAHVVDVAKMIRVYNNPKYAGQRVMLLFTNPTDVERIVEGGVKITSVNIGGMAFRQGKTQVNNAISVDAKDIEAFKKLNARGIELEARKVSTDPKLKMMDLIAKVDK

SEQ ID NO: 14306 - protein, 91 aa, Klebsiella pneumoniae
SQAIALSNETGLRLSLLTSALQPGQSPGANILNILRHEYLLSCKIIEDNVSTHRISRCNEFSSASCISKFDPDSCESGFFSPAANGWLHWR

SEQ ID NO: 14307 - protein, 300 aa, Klebsiella pneumoniae
GDKMRKLIVVASVAAGLLTGCDQKSTGKRETLSEALVAKSLSNMVPVKGGEFLMGDFGPLVGQKLPFSINQDDKVLHKVVLSDFSISKFKVTNDDYNKYLQITGVKKSPIHIFLKNYPSLQKGDYSVGVTWQQAKDYCQWLGKGSGKKIDLPTEAQWEYAARSRGQYFQFPTNNGEYLPGKNVPGKDELDKYTDGFGFPFYPVGKYPPNPLGLYDMGLSGSEWTNDWYAADYYSHSPVNDPQGPAQGTKKVLRGYIGGDRQYALTMFRQSKLPVPKIDKDDDYEKYGVGPQYVFRCVVNK

SEQ ID NO: 14308 - protein, 120 aa, Klebsiella pneumoniae
GDKMIKLIVVASVAAGLLTGCDQGNTTGSEKAAKALVDKSVSNMVPVQGGEFLMGDFGPLVGEKLPFSIQQDDKNLHKVILSDFSISKYKVTNDDFNVYLKVTDKKIHLWIYWQNVILLC

SEQ ID NO: 14309 - protein, 90 aa, Klebsiella pneumoniae
GDKMRKLIVVATVAASLLLGCDQKSTGKRETLSEALVAKSLSNMVPVKGGEFLMGDFGPLVGEKLPFSINQDDEVLHKVVFLCRLVWNEL

SEQ ID NO: 14310 - protein, 213 aa, Klebsiella pneumoniae
TMKIALMMENSQANKNAIILKELNAVADEKGFPVYNVGMSDENDHHLTYIHLGIMASILLNSKAVDFVVTGCGTGQGALMSLNIHPGVVCGYCIDPADAFLFAQINNGNALSLPFAKGFGWGAELNVRFIFEKAFTGRNGEGYPPERKEPQVRNAGILNQVKAAVVKENYLDTLRAIDPQLVKTAVSGPRFQQCFFENCQDKAIEDFVRQIVA

SEQ ID NO: 14311 - protein, 61 aa, Klebsiella pneumoniae
IIRIWINILFRKEISFSTGPIQKNWLVKRRFTIEMKLLLLLAISFVLGSINKLTLGLYGGT

SEQ ID NO: 14312 - protein, 399 aa, Klebsiella pneumoniae
HSRMKVKPTGYFLIHQYIDISALAQLMRYSHGAGASAEYNPSEKKLEGKIEGHASFAMGEAKAETALYLPDRLGVSLLFPAKKVTPQTPDGVCNMGALRFAMKLVLSGSVGASAAIELGVTVDWSGEMGKGYGIKGRPATLTAPPLPGQQQVNLKTSTIPEAQGGGEIGVFVGAQAGGNISGAIEWFDPHPDDTPVAIGVEKDNKPIVNKEKKFAAIAKLEAGMTVQAGAGGSGVFYITYIQGRFRIYCKAALCWGVGAKGEVGFEVDGSSFAAFMKSFMYMQRNVDYQKLEQMMAGDAFRSLCAIPIIMAAQGIQVGEAMLKNMVVILQQIRADLKDENKRVNLMDSILSNPDQLKYTPPETKGAVIATLIDQNWADWLDPRNQNNDFFPLTAGSSVL

SEQ ID NO: 14313 - protein, 78 aa, Klebsiella pneumoniae
KHNFTFCSILLTAAAQVDILLDELNGDDNAHKKNGHLSGCPLATYLLAGGSTAGRAFSRCARSTAIWTVSSRYGSGSW

SEQ ID NO: 14314 - protein, 96 aa, Klebsiella pneumoniae
IRVLHPLFRAHQLSLRLPLCFFILRPPFISVTGGYMTSYQLLRLRQVEQKTGLKRSQIYLYMKEGAFPRSIKIGPASVAWLESEIDEWINKKLSDR

SEQ ID NO: 14315 - protein, 270 aa, Klebsiella pneumoniae
GGAVTQSAMCIPLWPARNGNTAHLVMCPFAGGSSSAFRHWQAEQLADCALSLVTWPGRDRLRHLEPLRSITQLAALLANELEASVSPDTPLLLAGHSMGAQVAFETCRLLEQRGLAPQGLIISGCHAPHLHSERQLSHRDDADFIAELIDIGGCSPELQENQELMSLFLPLLRADFYATESYHYDSPDVCPPLRTPALLLCGSHDREASWQQVDAWRQWLSHVTGPVVIDGNHFYPIQQARSFFTQIVRHFPHAFSAMTALQKQPSTSER

SEQ ID NO: 14316 - protein, 293 aa, Klebsiella pneumoniae
GEYVAGGSMNNENTYGYVYILVSDKTPYIKIGGTDYLPEKRCKEINTQPPYCLYAPWRVADYRSVPDWHNVETWLHYLFRDSRVRTIANQKELFNVTPELAAHHLASLDQQPLTTKPKIDRLFHHQGLRDYLVKLFAIAGCEKWRHKEGVWVFSLFPGAHSGWSRYFTLSIHSHEVAFSTRSRDCQIHMLLADELIMDYPDIVQWVTDHKGGFEKPIYKTALSHAQQIWFEGEFEVGLQLLSFPEVQQAVATYWDRALTKYDYSLQAKYHNRIAVEEIFKQLQVQRQRESSAM

SEQ ID NO: 14317 - protein, 65 aa, Klebsiella pneumoniae
GTDVIRVEGMLLNDVYAARQKVSGKLRTGSSGDGRTHDNTGDIRHPGYLFRRGIQRNAKRMSQLS

SEQ ID NO: 14318 - protein, 289 aa, Klebsiella pneumoniae
RNDVGVRALSALHYRKILTFGVSMKLALLGRQAMMGAMAVVLMAGVSVKTFAAENLLNQIKERGTLRVGLEGTYPPFSFQGDDGKLTGFEVEFANELAKHLGVKADLKPTKWDGMLASLDSKRIDVVINQVTISDERKKKYDFSTPYTVSGVQALVKKGNEGVIKTAADLKGKKVGVGLGTNYEEWLRQNVQGVDVRTYDDDPTKYQDLRVGRIDAILVDRLAALDLVKKTNNTLALTGEAFSRQEAGVALRKGNDDLLKAVDGAIADMQKDGSLKALSEKWFGADVTK

SEQ ID NO: 14319 - protein, 633 aa, Klebsiella pneumoniae
WGDVMGRIADEGGMMILNKLTASLSPIVNGMLAVLAFVQQKQLVLALLAGLTMPFFASMKSDERQKAPLWKKLIIAFSLLCFLSGTLAPVVIGSFQWLYKIRPTSDNTVLAWSVRIAFTVTGIIFHIMLRRIFTPELDKIKKRLVKKTTLERELRTDVRTVKSLLPETLHYNPLDYIDLNKGIFTGMGRENEPMYLPLKDWQKQHADIIGTTGAGKGVAAGILLYQSILAGEGVFVMDPKDDEWAPHLYRKACEDAGKPFALIDLRKQQYQLNLIEDITPDELEELFVAGFSLAEKGQESDFYRIDDRKAARIAAQFVSDNPSTTIRDVYNGDYVQSIAEKIKAFFGKIEELALLNAINSPEGFSLKHIFDEGGCCYVVGSMRNSKIITAQRMLLVRLYQLAEKRDRVIDVPRPIAVYLSELKYHLSRSALEGLGAARDKGVHIIMDHQSIADLKDCPADLKGDAVVGAVVENAKFKLVYRVMDPDTAEWVARMSGTILVDDELRKAKTDNMLTETIDSERTIRQAERFFIDSNMILNLPDFVSFIFTTKTLPSASLISPIKVRKRQLKTFSVSPDIAATVAPVKIMLDFCEDDKPAMSDVMTTHPALFFDESEVKPVKPKPDDEEHLSPLDF

SEQ ID NO: 14320 - protein, 64 aa, Klebsiella pneumoniae
KICFTTSGASPRLGSSSSSRRGRLISARAMASICCSPPERVIARCPRRSSSRGNSWYIRALSSA

SEQ ID NO: 14321 - protein, 617 aa, Klebsiella pneumoniae
CGVVSKPVSDVFDAKAFLKTVTSQPGVYRMYDAGGTVIYVGKAKDLKKRLSSYFRSNLASRKTEALVALIAQIDVTVTHTETEALLLEHNYIKLYQPRYNVLLRDDKSYPFIFLSGDTHPRLAMHRGAKHAKGEYFGPFPNGYAVRETLALLQKIFPIRQCENSVYRNRSRPCLQYQIGRCLGPCVAGLVSEEEYAQQVEYVRLFLAGKDDQVLTQLIARMEKASQNLEFEEAARIRDQIQAVRRVTEKQFVSNTGDDLDVIGVAFDAGMACVHVLFIRQGKVLGSRSYFPKVPGGTELGEVVETFVGQFYLQGSQMRTLPGEILLDFNLGDKTLLADSLSELAGRRINVQTKPRGDRARYLKLARTNAATALTTKLSQQSTIHQRLQALASVLELPAVKRMECFDISHTMGEQTVASCVVFDSNGPLRAEYRRYNITGITPGDDYAAMNQVLRRRYGKAIDDNKIPDVILIDGGKGQLAQAKAVFAELDVPWDKHHPLLLGVAKGSDRKAGLETLFFEPEGEGFSLPPDSPALHVIQHIRDESHDHAISGHRKKRAKVKSTSSLETIEGVGPKRRQMLLKYMGGLQGLQQASVEEIAKVPGISHALAEKIFYSLKH

SEQ ID NO: 14322 - protein, 121 aa, Klebsiella pneumoniae
FFSVNSWKLGPLKRRKQAVFMALKWVQSQADYNNIMQHLTLSPGEKKGSKELNEKDVIKFLGIGERKLFFYTNYGEKLTLLHNNLPVFVDPDEPFKPIPDILMSEYLAMIDDQHPTGTMTA

SEQ ID NO: 14323 - protein, 468 aa, Klebsiella pneumoniae
GISVRAFGPVCRPMKAKGTGGAMKIFRPLWRDGAFLVPQQFQQQARWDAHVADTVSRMALAHPWGVLRAEFDASALTLSRLNATRLIVRFTDGTLIDTELADILPPVRDVSDVMQDSVAVLLALPLLSASGGNLDDGQESARPRRWRAEQVTVQELAGHERSELAVLRHALTLRLSTEENAAFLTCPVARLVRDAQGQWIVDPEFIPPLLSLAASPTLVSELGELLHRLQARRRRLMAMRRESNARMADFAVADVSLFWLLNALNSAEPVLSELHLDPSRHPELLYRELARLAGSLLTFSLEHHLEAIPRYRHASPEQVFPPLFALLDTLLEVSLPSRVIAIVLEQGADREIWRGRLHDARLREGADFYLSVRSSLPPHQLQSRFPQLCKAGSHDDVAEVVNIALSGIAIKPLSHVPAAIPLRLENQYFALDLSTDAARAMLEAGNCTFYTPESLGDVKLELFAVLRS

SEQ ID NO: 14324 - protein, 214 aa, Klebsiella pneumoniae
HDGVWVDKDRCVKLRWLLILVVFLAGCSSKHDYTNPPWNPEVPVKRAMQWMPISEKAGAAWGVDPQLITAIIAIESGGNPAVVSKSGAVGLMQLKPSTSGRDVYRRMGWRGEPSVSELKNPERNISMGAAYLSILENGPLAGIKDPQVMRYAVVVSYANGAGALLRTFSSNRLDAIEEINDLDADEFFEHVVKKHPAPQAPRYIWKLQKALDAM

SEQ ID NO: 14325 - protein, 466 aa, Klebsiella pneumoniae
NALVDAFITLISFPVLFQSSATGARQRVDNKLETCMHSTTSQMSTRDRIGAILRVTSGNFLEQFDFFLFGFYATYIAHTFFPASSEFASLMMTFAVFGAGFLMRPIGAIVLGAYIDKVGRRKGLIVTLSIMATGTFLIVLIPSYQTIGLWAPLLVLIGRLLQGFSAGAELGGVSVYLAEIATSGRKGFYTSWQSGSQQVAIMVAAAMGFALNAVLEPSAISDWGWRIPFLFGCLIVPFIFILRRKLEETQEFTARRHHLAMRQVFATLLANWQVVIAGMMMVAMTTTAFYLITVYAPTFGKKVLMLSASDSLLVTLLVAISNFFWLPVGGALSDRFGRRSVLIAMTLLALATAWPALTMLANAPSFLMMLSVLLWLSFIYGMYNGAMIPALTEIMPAEVRVAGFSLAYSLATAVFGGFTPVISTALIEYTGDKASPGYWMSFAAICGLLATCYLYRRSAVALQTAR

SEQ ID NO: 14326 - protein, 105 aa, Klebsiella pneumoniae
VTIVCCVTERNEMEEQAKRSPGGKLALWALYAFCGYCVWVIVRYWWVVGKIHSVPGASVEGDFGTTAGKWLGALLGMLVLGGIGSILGAVVWYTRPSRGEQDHQR

SEQ ID NO: 14327 - protein, 183 aa, Klebsiella pneumoniae
RAPVTPSRLIRIFFMAVPGMAQKLNTQMNLEFHASNVYLNLSEWCARHRFDGAATFLRTRAQSSITLTMRVFDYLKKAGSWPIVNPDHACNPECTSLEDLFTQTLSDYQQRSRLLSGLAQEAKAQSDDSTWRFLTLLAEEQQQDGLLLQSVLEEIRNADKAGLGMEQTDRRLMAIVGEAQKAH

SEQ ID NO: 14328 - protein, 141 aa, Klebsiella pneumoniae
HRAVQFMAQLVDKIVERHLAVDVNTLCRFIQHQQLRTVEQGAGQQYALRFAAGELLHRRIDQMPRLHALQRRQDVVFTGARAQTQEAANGQRQRGVQMQFLRHIADAQACVTLDNTLCRCYQPENHPHKGRFAGAVGAQQG

SEQ ID NO: 14329 - protein, 129 aa, Klebsiella pneumoniae
TSGFPRPGRLAASPRTRSTPAADRLARFGTERYSAASRAATAPDAPRRGGAPVPPPAARKPAIPVPDAPPPGTAPAAATAPRCLPVDTSRDGFRRAPNARETDRRYPRRPEPLPPENPRAAGRFPIADG

SEQ ID NO: 14330 - protein, 524 aa, Klebsiella pneumoniae
SIKVDNKQYPITPSITIRLCDVAGWRYRIHVHATPKLYQSTEYYMSRRLRRTKIVTTLGPATDRDNNLEKVIAAGANVVRMNFSHGTPEDHQLRADKVREIAAKLGRHVAILGDLQGPKIRVSTFKEGKIFLNVGDKFLLDANLGKGEGDKEKVGIDYKGLPADVVPGDILLLDDGRVQLKVLEVQGMKVFTEVTVGGPLSNNKGINKLGGGLSAEALTDKDKADIVTAAKIGVDYLAVSFPRCGEDLNYARRLARDAGCDAKIVAKVERAEAVCDQDAMDDVILASDVVMVARGDLGVEIGDPELVGIQKALIRRARQLNRSVITATQMMESMITNPMPTRAEVMDVANAVLDGTDAVMLSAETAAGQYPSETVAAMARVCLGAEKIPSLNVSKHRLDVQFDNVEEAIAMSAMYAANHLKGITAIITMTESGRTALMTSRISSGLPIFALSRHERTLNLTALYRGVTPVFFDSQNDGVAAAHDAVNLLRDKGYLVSGDLVVVTQGDVMSTIGSTNTTRILTVE

SEQ ID NO: 14331 - protein, 580 aa, Klebsiella pneumoniae
GIPVNIQALLSEKVSQALIAAGAPADCEPQVRQSAKVQFGDYQANGVMAVAKKLGMAPRQLAEQVLSHLDLNGIANKVEIAGPGFINIFLDPAFLADNVNRALQSERLGVTKPQAQTIVVDYSAPNVAKEMHVGHLRSTIIGDASVRTLEFLGHKVIRANHVGDWGTQFGMLIAYLEKQQQENAGEMALADLEGFYREAKKHYDEDEAFAERARSYVVKLQGGDEYFLQMWRKLVDITMSQNQITYDRLNVTLTRDDVMGESLYNPMLPGIVADLKAKGLAVESEGATVVFLDEYKNKEGEPMGVIIQKKDGGYLYTTTDIACAKYRYETLHADRVLYYIDSRQHQHLMQAWTIVRKAGYVPDSVPLEHHMFGMMLGKDGKPFKTRAGGTVKLADLLDEALERARRLVAEKNPDMSADELENLAKVVGIGAVKYADLSKNRTTDYVFDWDNMLAFEGNTAPYMQYAYTRVLSVFRKAGIDENAMIDAPVVIAEDREAQLAARLLQFEETLSVVAREGTPHVMCAYLYDLAGLFSGFYEHCPILSAESEETRNSRLKLALLTAKTLKLGLDTLGIETVERM

SEQ ID NO: 14332 - protein, 555 aa, Klebsiella pneumoniae
CSQVPTPFRWQIRNDCRRSFIKRHRITAMKTRKIGLANYLAYGAGDFLGAGTTALTAAWLLYFYTTFCGLTPIEATLIFAAARVLDAVVSPLMGFLTDNFGTTWLGKRFGRRKFFILLGIPCVFSYSAMWVGEMGFWYYLATYLLFDMVYTMILVPYETLVPEMTDDFKQKTKFSGARISMAQMSAILASFLPGILLSWLGKDNASSFFYASLVFSVLCAVMLTLVWCFTWERPREAWSEAALRAEAEKQNLTLAQSLNRLVIELSSTLRIKIFRQHLGMYLGGYIAQDVFNAVFTYYVVFVLMQEAAVASNLLGTMAIFQFIAVIAMIPLCIRFGPAPSYRMVVVLFGLSSLSYALLYYAGLSDVYSLLLLISAVAGLGRGGINYVPWNTYTYIADVDEAITGQRREGIFAGIMTLTRKASQAGAVMLVGIIMQLSGFVSGQKIQPEGVSHTILLILSVGTLVVLACGFLVSLRFKLNLHTHSVLRSETLRMRELGYAQSEQTSAEHRAVVELLAGMPYDCLWGNNNIGYLNRHKPAAPALIKGGALNSTYTRG

SEQ ID NO: 14333 - protein, 263 aa, Klebsiella pneumoniae
SPQVKSSDAAPNLMATDFRSGGNRWVCRCVADMEDAENSLSSAAMTPRGRLRVDVPSPLARLILVPALPAFHARYPDIQIDMGVSDRVVDLIGDNVDCVLRGGQITDQSLIARHVGDLQIGVYVAPSYVERLGAPAHPRELQNTDHCIVGFLSSRTSKIDPLVLCSENERIEITGNYVLAVDDGNAYLEAGLVGLGVIALPNYMAAAHQAVGALIPLFTQWRISPMPLYLAFPPNRHVNAKLRVFIDWIVEVMLQHVPIANHQ

SEQ ID NO: 14334 - protein, 571 aa, Klebsiella pneumoniae
RREVCATYCERKMDKPLRLKLKKCYHLARPAHVVNACFIAVLFFSTLLIWREINVLEEAYVANQRNNLANVAHEMDGLLQFNIDRMMFFRHGMQAALEQPLDIDVLRKASQRYLSQRHQQAWRVALPNRRTLPVFGISGSVAGHNPILLVDDPLAADELMATLELGYLLNLTQHDRDFAERMQYISRSGFFTSTLPLRDESQVITHYSQALSAPWFTRQTQRNNPGRGVIWQTFPDDDPQLEEQVVTASIPLDFAGYWRGVLAMDFSVSEIKAFLVSAMQGGQEGEYQLYDSHLNLLASSTPGNVLTLLSPREQELLSRAFVHDNQGGLRLLTRYISWAKLRNFDGVLLRIHTLREGVRGNFGTITIALTLMWVLFTLMLLLSWLVIRRMVRNMSVLQTSLEWQAWHDALTRLLNRGALFEQAMAVASDCQRSGRPLAVIQLDLDHFKHINDRYGHQAGDRVLSMVASTLSSAVRQGDLLGRVGGEEFCIVMPNTTLQEAAAVAERLRQRIQGREVFLHNNVTLRVSASLGVSASEERGEYQFEALQSVADGRLYLAKQNGRNQVCFRSAA

SEQ ID NO: 14335 - protein, 175 aa, Klebsiella pneumoniae
HLLFNSRSATMLKTDMIDKLNEQMNLELYSSLLYQQMSAWCSYHSFEGAAAFLRRHAQEEMTHMQRLFDYLTDTGSLPRINAIASPFAEYASLDELFRQTYEHEQLITQKINELAHAAMTSQDYPTFNFLQWYVAEQHEEEKLFKSVIDKLTLAGKSGEGLYFIDKELATLDAQN

SEQ ID NO: 14336 - protein, 197 aa, Klebsiella pneumoniae
RALLTSKPMANWQQIEQLADITADLPRFSDALQRFTARLGLEIAGLDADHISLRCHQNTTAERWRRGLEQCGTLLSENMINGRPICLFKLAEPVCVAHWRFHIVELPWPGEKRYPHEGWEHIEIVLPGDPATLNARALALLADDGLSQPGIVVKTSSPKGEHERLPNPTLAVTDGSVTVKFHPWSIEQIVASEQADT

SEQ ID NO: 14337 - protein, 305 aa, Klebsiella pneumoniae
FHPLMKSFPLMSALLLMNMLEKIQSRLEHLSKSERKVAEVILATPEQAIHSSIAALALEAGVSEPTVNRFCRSLETRGFPDFKLHLAQSLAHGTLYVNRNVDEDDSVESYTGKIFESAMASLDQVHHSLDMSAVNRAVDLLTQAKKIAFFGLGSSAAVAHDAMNKFFRFNVPVIYSDDIVLQRMSCMNCDDDDVVVIISHTGRTKSLVELAQLARENDAMVIALTSAGTPLAREATLAITLDVPEDTDIYMPMVSRLAQLTVIDVLATGFILRRGAKFRDNLKRVKEALKESRFDKEPFVPSDNQ

SEQ ID NO: 14338 - protein, 695 aa, Klebsiella pneumoniae
LSFSIHHCRYFWRFAVLQGLTTMKMTRLYPLALGGLLLPAIANAQTSQQDESTLVVTASKQSSRSASANNVSSTVVSAPELSDAGVTASDKLPRVLPGLNIENSGNMLFSTISLRGVSSAQDFYNPAVTLYVDGVPQLSTNTIQALTDVQSVELLRGPQGTLYGKSAQGGIINIVTQQPDSTPRGYIEGGVSSRDSYRSKFNLSGPIQDGLLYGSVTLLRQVDDGDMINPATGSDDLGGTRASIGNVKLRLAPDDQPWEMGFAASRECTRATQDAYVGWNDIKGRKLSISDGSPDPYMRRCTDSQTLSGKYTTDDWVFNLISAWQQQHYSRTFPSGSLIVNMPQRWNQDVQELRAATLGDARTVDMVFGLYRQNTREKLNSAYDMPTMPYLSSTGYTTAETLAAYSDLTWHLTDRFDIGGGVRFSHDKSSTQYHGSMLGNPFVDQGKSNDDQVLGQLSAGYMLTDDWRVYTRVAQGYKPSGYNIVPTAGLDAKPFVAEKSINYELGTRYETADVTLQAATFYTHTKDMQLYSGPVGMQTLSNAGKADATGVELEAKWRFAPGWSWDINGNVIRSEFTNDSELYHGNRVPFVPRYGAGSSVNGVIDTRYGALMPRLAVNLVGPHYFDGDNQLRQGTYATLDSSLGWQATERMNISVYVDNLFDRRYRTYGYMNGSSAVAQVNMGRTVGINTRIDFF

SEQ ID NO: 14339 - protein, 274 aa, Klebsiella pneumoniae
QGISMARIIVVTSGKGGVGKTTSSAAIATGLAQKGKKTVVIDFDIGLRNLDLIMGCERRVVYDFVNVIQGDATLNQALIKDKRTENLYILPASQTRDKDALTREGVDKVLEELKKMEFDFIVCDSPAGIETGALMALYFADEAIITTNPEVSSVRDSDRILGILASKSRRAENGEEPIKEHLLLTRYNPGRVNKGDMLSMEDVLEILRINLVGVIPEDQSVLRASNQGEPVILDAASDAGKAYADTVERLLGEERPFRFIEEEKKGFLKRLFGG

SEQ ID NO: 14340 - protein, 88 aa, Klebsiella pneumoniae
SHELPNRLDFAYFIYHTNMYTSRLPMLARQLTCTPGLFRCRFFLFSALVYGSTVATSPSTGCDLCVNELCMLKTVCYNGTSRGQRVFD

SEQ ID NO: 14341 - protein, 344 aa, Klebsiella pneumoniae
IVNSDFSLHESELKLEFTMHKFTKALAAIGLAAVMSQSAMAENLKLGFLVKQPEEPWFQTEWKFADKAGKDLGFDVIKIAVPDGEKTLNAIDSLAASGAKGFVICTPDPKLGSAIVTKARGYDMKVITVDDQFVNAKGKPMESVPLVMMAASEIGARQGQELYKEMQKRGWDVKDTAVMAITADELDTARRRTTGSIDALKAAGFPDAQIYRVPTKSNDIPGAFDAGNSMLVQHPQVKHWLIVGMNDNTVLGGVRATEGQGFKAPDVIGIGINGVDAVNELSKAQPTGFYGSLLPSPDIHGYKTSEMLYNWVTKGVEPPKFTAVTDVVLITRDNFKEELAKKGL

SEQ ID NO: 14342 - protein, 526 aa, Klebsiella pneumoniae
RMNSSFKSLIEQYPLPIAEQLRHWAARYASRIAVVDAKGSLTYSALDAQVDELAAGLSSLGLRSGEHVIVQLPNDNAFVTLLFSLLRLGVIPVLAMPSQRALDIDALIELAQPVAYVIHGENHAELARQMAHKHACLRHVLVAGETVSDDFTPLFSLHGERQAWPQPDVSATALLLLSGGTTGTPKLIPRRHADYSYNFSASAELCGISQQSVYLAVLPVAHNFPLACPGILGTLACGGKVVLTDSASCDEVMPLIAQERVTHVALVPALAQLWVQAREWEDSDLSSLRVIQAGGARLDPTLAEQVIATFDCTLQQVFGMAEGLLCFTRLDDPHATILHSQGRPLSPLDEIRIVDQDENDVAPGETGQLLTRGPYTISGYYRAPAHNAQAFTAQGFYRTGDNVRLDEVGNLHVEGRIKEQINRAGEKIAAAEVESALLRLAEVQDCAVVAAPDTLLGERICAFIIAQQVPTDYQQLRQQLTRMGLSAWKIPDQIEFLDHWPLTAVGKIDKKRLTALAVDHYRHSAQ
